US009970926B1

(12) United States Patent
Kraft et al.

(10) Patent No.: US 9,970,926 B1
(45) Date of Patent: May 15, 2018

(54) BACILLUS THURINGIENSIS TOXIN RECEPTORS AND USES THEREOF

(71) Applicant: MONSANTO TECHNOLOGY LLC, St. Louis, MO (US)

(72) Inventors: Edward Kraft, Brookline, MA (US); Renata Bolognesi, St. Louis, MO (US); Artem Evdokimov, Foristell, MO (US); Farhad Moshiri, Chesterfield, MO (US); Meiying Zheng, Wildwood, MO (US); Victor M Guzov, Cambridge, MA (US)

(73) Assignee: Monsanto Technology LLC, St. Louis, MO (US)

(*) Notice: Subject to any disclaimer, the term of this patent is extended or adjusted under 35 U.S.C. 154(b) by 534 days.

(21) Appl. No.: 14/548,905

(22) Filed: Nov. 20, 2014

Related U.S. Application Data

(60) Provisional application No. 61/907,492, filed on Nov. 22, 2013.

(51) Int. Cl.
| | |
|---|---|
| *C07H 21/02* | (2006.01) |
| *C12N 15/12* | (2006.01) |
| *A01K 67/033* | (2006.01) |
| *C12N 5/10* | (2006.01) |
| *G01N 33/50* | (2006.01) |
| *C12N 9/16* | (2006.01) |
| *C07K 14/435* | (2006.01) |
| *C07K 14/705* | (2006.01) |
| *C12N 9/48* | (2006.01) |
| *C12N 9/64* | (2006.01) |
| *C07K 16/40* | (2006.01) |
| *G01N 33/68* | (2006.01) |
| *C07K 16/28* | (2006.01) |

(52) U.S. Cl.
CPC ... *G01N 33/5085* (2013.01); *C07K 14/43563* (2013.01); *C07K 14/705* (2013.01); *C07K 16/28* (2013.01); *C07K 16/40* (2013.01); *C12N 9/16* (2013.01); *C12N 9/485* (2013.01); *C12N 9/6416* (2013.01); *G01N 33/5014* (2013.01); *G01N 33/6845* (2013.01); *G01N 2500/04* (2013.01); *G01N 2500/10* (2013.01)

(58) Field of Classification Search
CPC ............ C07K 14/43563; C07K 14/705; C07K 16/40; C12N 9/16; C12N 2510/00; G01N 33/5085; G01N 33/5014; A01K 67/033
USPC ................. 536/23.1; 435/320.1, 325; 800/13
See application file for complete search history.

(56) References Cited

U.S. PATENT DOCUMENTS 7,741,118 B1 6/2010 Fischhoff et al.
8,034,997 B2 10/2011 Bogdanova et al.

OTHER PUBLICATIONS

Tanaka et al. (2013) FEBS J., vol. 280, 1782-1794.*
Uniprot Accession No. D8V116, integrated into the database on Oct. 5, 2010.*
Gill et al. (2002) Insect Mol. Biol., vol. 11(6), 619-625.*
Baxter et al., "Parallel evolution of *Bacillus thuringiens* toxin resistance in lepidoptera," *Genetics*, 189(2):675-679, 2011.
Chen et al., "Synergism of *Bacillus thuringiensis* toxins by a fragment of a toxin-binding cadherin," *Proc Natl Acad Sci USA*, 104(35):13901-13906, 2007.
Gahan et al., "An ABC transporter mutation is correlated with insect resistance to *Bacillus thuringiensis* Cry1Ac toxin," *PLOS Genet*, 6(12):e1001248, 2010.
Gomez et al., "Molecular basis for *Bacillus thuringiensis* Cry1Ab toxin specificity: two structural determinants in the *Manduca sexta* Bt-R1 receptor interact with loops alpha-8 and 2 in domain II of Cy1Ab toxin", *Biochemistry*, 42(35):10482-10489, 2003.
Gomez et al., "Role of receptor interaction in the mode of action of insecticidal Cry and Cyt toxins produced by *Bacillus thuringiensis,*" *Peptides*, 28(1):169-173, 2007.
Griko et al., "Univalent binding of the cry1 Ab toxin of *Bacillus thuringiensis* to a conserved structural motif in the cadherin receptor BT-R," *Biochem*, 46:10001-10007, 2007.
Hue et al., "Bt-R1a extracellular cadherin repeat 12 mediates *Bacillus thuringiensis* Cry1Ab binding and cytotoxicity," *J Biol Chem*, 279(27):28051-28056, 2004.
Juarat-Fuentes et al., "Reduced levels of membrane-bound alkaline phosphatase are common to lepidopteran strains resistant to cry toxins from *Bacillus thuringiensis,*" *PLOS One*, 6(3):e17606, 2011.
Morin et al., "Three cadherin alleles associated with resistance to *Bacillus thuringiensis* in pink bollworm," *Proc Natl Acad Sci U S A*, 100(9):5004-5009, 2003.
Ochoa-Campuzano et al., "An ADAM metalloprotease is a Cry3Aa *Bacillus thuringiensis* toxin receptor," *Biochem Biophys Res Commun*, 362(2):437-442, 2007.
Rajagopal et al., "Silencing of midgut aminopeptidase N of *Spodoptera litura* by double-stranded RNA establishes its role as *Bacillus thuringiensis* toxin receptor," *J Biol Chem*, 277:46849-46851, 2002.
Tiewsiri et al., "Differential alteration of two aminopeptidases N associated with resistance to *Bacillus thuringiensis* toxin Cry1Ac in cabbage looper," *Proc Natl Acad Sci U S A*, 108(34):14037-14042, 2011.

(Continued)

Primary Examiner — Anne Marie S Wehbe
(74) *Attorney, Agent, or Firm* — Dentons US LLP; Carine M. Doyle, Esq.

(57) ABSTRACT

The invention relates to identification and characterization of recombinant DNA and polypeptides for specific Bt toxin receptors. In particular, the Bt toxin receptors of the invention include those derived from the Lepidopteran super family including the species *Trichoplusiani ni, Pseudoplusia includens, Helicoverpa zea,* and *Spodoptera frugiperda*. The receptors of the invention further include those derived from the Coleopteran super family and particularly from the species *Diabrotica virgifera virgifera*. The recombinant DNA and polypeptides so provided are useful in the identification and design of novel Bt toxin receptor ligands including novel or improved insecticidal toxins for use in a variety of agricultural applications. Materials and methods for identifying novel toxins are also disclosed herein. The invention also provides methods for selecting toxins to combine to control insect populations by manipulating Bt toxin receptor.

9 Claims, 10 Drawing Sheets

(56) References Cited

OTHER PUBLICATIONS

Vachon et al., "Current models of the mode of action of *Bacillus thuringiensis* insecticidal crystal proteins: a critical review," *J Invertebr Pathol*, 111(1):1-12, 2012.
Xie et al., "Single amino acid mutations in the cadherin receptor from *Heliothis virescens* affect its toxin binding ability to Cry1A toxins," *J Biol Chem*, 280(9):8416-8425, 2005.
Zhang et al., "Resistance of *Trichoplusia ni* to *Bacillus thuringiensis* toxin Cry1Ac is independent of alteration of the cadherin-like receptor for Cry toxins," *PLOS One*, 7(5):e35991, 2012.
GenBank: AAX39863.1, aminopeptidase N1 [*Trichoplusia ni*].
GenBank: AEA29692.1, cadherin [*Trichoplusia ni*].
GenBank: AEG79734.1, alkaline phosphatase [*Trichoplusia ni*].
GenBank: AAA22331.1, crystal protein [*Bacillus thuringiensis*].
GenBank: AAA22342.1, crystal protein B2 [*Bacillus thuringiensis*].
Ferré et al., "Resistance to the *Bacillus thuringiensis* bioinsecticide in a field population of *Plutella xylostella* is due to a change in a midgut membrane receptor," *Proc Nati Acad Sci U S A* 88:5119-5123, 1991.
Francis et al., "Further characterization of BT-R1, the cadherin-like receptor for Cry1Ab toxin in tobacco hornworm (*Manduca sexta*) midguts," *Insect Biochem Mol Biol* 27:541-550, 1997.
Gahan et al., "Identification of a gene associated with Bt resistance in *Heliothis virescens*," *Science* 293:857-860, 2001.
Herrero et al.,"Different mechanisms of resistance to *Bacillus thuringiensis* toxins in the indianmeal moth," *Appl Environ Microbiol* 67:1085-1089, 2001.
Ihara et al., "Purification and partial amino acid sequences of the binding protein from *Bombyx mori* for Cry1Aa δ-endotoxin of *Bacillus thuringiensis*," *Comp Biochem Physiol B Biochem Mol Biol* 120:197-204, 1998.

Iracheta et al., "Screening for *Bacillus thuringiensis* crystal proteins active against the cabbage looper, *Trichoplusia ni*," *J Invertebr Pathol* 76:70-75, 2000.
Jiménez-Juárez et al., "*Bacillus thuringiensis* Cry1Ab mutants affecting oligomer formation are non-toxic to *Manduca sexta* larvae," *J Biol Chem* 282:21222-21229, 2007.
Keeton et al., "Ligand specificity and affinity of BT-R1, the *Bacillus thuringiensis* Cry1A toxin receptor from *Manduca sexta*, expressed in mammalian and insect cell cultures," *Appl Environ Microbiol* 63:3419-3425, 1997.
Keeton et al., "Effects of midgut-protein-preparative and ligand binding procedures on the toxin binding characteristics of BT-R1, a common high-affinity receptor in *Manduca sexta* for Cry1A *Bacillus thuringiensis* toxins," *Appl Environ Microbiol* 64:2158-2165, 1998.
Nagamatsu et al.,"Identification of *Bombyx mori* midgut receptor for *Bacillus thuringiensis* insecticidal Cry1A(a) toxin," *Biosci Biotechnol Biochem* 62:718-726, 1998.
Vadlamudi et al., "Cloning and expression of a receptor for an insecticidal toxin of *Bacillus thuringiensis*," *J Biol Chem* 270:5490-5494, 1995.
Van Rie et al., "Specificity of *Bacillus thuringiensis* δ-endotoxins: Importance of specific receptors on the brush border membrane of the mid-gut of target insects," *Eur J Biochem* 186:239-247, 1989.
Xiao et al., "Mis-splicing of the ABCC2 gene linked with Bt toxin resistance in *Helicoverpa armigera*," *Sci Rep* 4:6184, 2014.
Xu et al., "Disruption of a cadherin gene associated with resistance to Cry1Ac {delta}-endotoxin of *Bacillus thuringiensis* in *Helicoverpa armigera*," *Appl Environ Microbiol* 71:948-954, 2005.

* cited by examiner

Cry1Ab-TC blot

TBR2-mutant   TBR3-mutant   −   +

2B

Cry1Ac-TC blot

TBR2-mutant   TBR3-mutant   −   +

3A.

Superdex 200 10/30G Sizing Column

3B.

Pulldown attempt for Cadherin TBR3
with Cry1Ab on NiNTA resin

3C.

4A

4B.

4C.

5A.

5B.

5C.

6A.

6B.

6C.

7A.

7B.

BACILLUS THURINGIENSIS TOXIN RECEPTORS AND USES THEREOF

CROSS-REFERENCE TO RELATED APPLICATIONS

This application claims the priority of U.S. Provisional Appl. Ser. No. 61/907,492, filed Nov. 22, 2013, the entire disclosure of which is incorporated herein by reference.

INCORPORATION OF SEQUENCE LISTING

The sequence listing contained in the file named "59644_a_ST25.txt", which is 1,015,808 bytes (measured in operating system MS-Windows) and was created on Nov. 14, 2014, is contemporaneously filed by electronic submission (using the United States Patent Office EFS-Web filing system) and incorporated herein by reference in its entirety.

FIELD OF THE INVENTION

The field of the invention relates to isolation and characterization of recombinant nucleic acid and polypeptides for *Bacillus thuringiensis* (Bt) toxin receptors. This invention further relates to methods of identifying and designing toxin receptor ligands including novel or improved insecticidal toxins as well as the development of enhanced assays and assay methods, including array diagnostics and kits for determining receptor ligand interactions and effectiveness of certain insecticidal polypeptides.

BACKGROUND OF THE INVENTION

*Bacillus thuringiensis* (Bt) is a spore-forming Gram-positive bacterium. During sporulation, Bt produces proteinaceous inclusions which are composed of proteins known as Cry proteins. With their relatively high specificity for particular insect pests and their general level of safety for man and the environment, Cry proteins have been used as biopesticides for decades. Bt strains are classified into subspecies or varieties, based on biochemical and serological criteria (de Barjac, ENTOMOPHAGA 7: 5-61 (1962); de Barjac). Certain Cry toxins derived from Bt are insecticidal and may be used for insect control. Their primary action is to lyse midgut epithelial cells in susceptible insect species. Cry toxins are first ingested as protoxins which are then solubilized and proteolytically converted to smaller, protease-stable polypeptides, in the insect midgut. These activated toxins, also called toxic core, then bind to specific receptors at the surface of midgut epithelial cells, allowing them to insert into the membrane and form pores which are permeable to small molecules such as inorganic ions, amino acids and sugars causing extensive damage and disruption to insect cells. Destruction of the cells results in extensive damage to the midgut epithelial tissue and death of the insect.

Specific binding of endotoxin to specific receptors located in the insect midgut is one step in the mode of insecticidal action. Cry toxins interact sequentially with multiple receptors (Gómez et al. (2007) PEPTIDES, 28(1):169-7; Vachon et al. J (2012) INVERTEBR. PATHOL., 111(1):1-12.). For Cry1A toxins (Lepidopteran specific toxins), at least five different protein receptors have been described to be involved in the cascade of interactions: a cadherin-like protein ("CADR"), a glycosylphosphatidyl-inositol (GPI)-anchored aminopeptidase-N (APN), a GPI-anchored alkaline phosphatase (ALP) and a 270 kDa glycoconjugate transmembrane ABC transporter. Recently, it has been reported that an "A Disintegrin And Metalloprotease" or "ADAM" metalloprotease is a Cry3Aa toxin Coleopteran receptor (Ochoa-Campuzano et al. (2007) BIOCHEMICAL AND BIOPHYSICAL RESEARCH COMMUNICATION 362, 437-442). In addition, it has been proposed that glycolipids are also important Cry-receptor molecules in insects and nematodes.

A threat to the use of Cry toxins is the development of insect resistance. No single glycoprotein appears to be essential for Cry1A toxicity; e.g. variants of Cry1Ac which eliminate binding to a 115 kDa APN only result in a two-fold decrease in toxicity (Raj agopal et al. (2002) J BIOL CHEM., 277:46849-51). RNA interference directed against midgut APNs produces a measurable but only slight decrease of Cry1Ac toxicity. Therefore it has been suggested that the main significance of Cry1A toxin binding to these glycoproteins seems to be to an increase in the concentration of the pre-pore oligomer at the membrane surface, acting to increase the probability of eventual insertion into the membrane of the pore forming portion of the toxin by some other mechanism.

One mechanism of resistance to Cry toxins is the interruption of toxin-receptor interactions. Reduced levels of membrane-bound alkaline phosphatase are common to Lepidopteran strains resistant to Cry toxins derived from *Bacillus thuringiensis* (Jurat-Fuentes et al. (2011) PLoS ONE. 6(3): e17606. doi: 10.1371/journal.pone.0017606.). A map-based cloning approach using a series of backcrosses identified ABC (ATP-binding cassette) transporter ABCC2 as the resistance gene in the cotton pest *Heliothis virescens* (Gahan et al. (2010) PLoS GENET. 6(12):e1001248. doi: 10.1371/journal.pgen.1001248). An inactivating mutation in this gene is genetically linked to Cry1Ac resistance and is correlated with loss of Cry1Ac binding to membrane vesicles.

Therefore, identification of Bt toxin receptors in insects and the receptors' utility for changing or modulating resistance to various Bt toxins can be useful for investigating overall Bt toxin-Bt toxin receptor interactions, selecting and designing improved toxins, developing novel pesticides and/or the creation of new Bt toxin resistance management strategies.

SUMMARY OF THE INVENTION

One aspect of the present invention provides recombinant receptor polypeptides that are involved in Bt toxin binding, in which the recombinant receptor polypeptide has Bt toxin binding activity and has an amino acid sequence selected from the group consisting of: a) SEQ ID NO: 23 through 44, 92 through 138, 143 through 146, and 168 through 186; b) an amino acid sequence having at least 80% sequence identity to the amino acid sequence set forth in SEQ ID NO: 23 through 44, 92 through 138, 143 through 146, and 168 through 186; c) an amino acid sequence having at least 90%, at least 91%, at least 92%, at least 93%, at least 94%, at least 95%, at least 96%, at least 97%, at least 98%, at 99% sequence identity to an amino acid sequence set forth in SEQ ID NO: 23 through 44, 92 through 138, 143 through 146, and 168 through 186; and e) an amino acid sequence consisting of the ligand binding region as set forth in SEQ ID NO: 143 through 146.

Another aspect of the present invention provides recombinant DNA that encodes the receptor polypeptides or fragment thereof, which is or complementary to a sequence selected from the group consisting of SEQ ID NO: 1 through 22, 45 through 91, 139 through 142, and 149 through 167.

Another aspect of the present invention provides antibodies that bind to the recombinant receptor polypeptide having an amino acid sequence selected from the group consisting of SEQ ID NO: 23 through 44, 92 through 138, 143 through 146, and 168 through 186, or fragments thereof.

Another aspect of the present invention provides recombinant DNA vectors comprising a nucleotide sequence encoding the recombinant receptor polypeptide disclosed herein. The recombinant DNA vector can further comprise a promoter for expressing the recombinant receptor polypeptide either in a prokaryotic or eukaryotic cell.

Yet another aspect of the present invention provides methods of screening for ligands that bind Bt toxin receptors, which methods comprise the steps of: a) providing at least one Bt toxin receptor comprising a recombinant receptor polypeptide disclosed herein; b) contacting the receptor polypeptide with a sample; and c) determining binding characteristics of the sample ligand.

Yet another aspect of the present invention provides methods to assess the binding affinity of a candidate ligand for a receptor polypeptide disclosed herein, which method comprises the steps of: a) contacting the candidate ligand with the receptor; and b) measuring the binding affinity of the candidate ligand bound to the receptor.

Yet another aspect of the present invention provides methods to assess the cytotoxicity of a candidate ligand, which method comprises the steps of: a) contacting the candidate with cells that express the toxin receptor comprising a receptor polypeptide disclosed herein; and then, b) measuring the cytotoxicity effect of the candidate ligand on the cells in terms of cell death indices.

Yet another aspect of the present invention provides a method to assess the binding affinity of a first candidate ligand for an insect receptor comprising a receptor polypeptide disclosed herein under the presence of a second candidate ligand, comprising the steps of: a) contacting the insect receptor with a first concentration of a first candidate ligand; b) measuring the binding affinity of the first candidate ligand; c) contacting the insect receptor with a second concentration of a second candidate ligand, d) measuring the binding affinity of the first candidate ligand, e) determining whether and how the presence of the second candidate ligand influences the binding affinity of the first candidate ligand; and optionally, f) repeating steps c) through e) with increasing concentrations of the second candidate to determine candidate ligands or combinations thereof of particular interest for use in agricultural applications including transgenic plants.

Yet another aspect of the present invention provides a method to engineer a candidate synthetic ligand containing domains or specified regions of ligands disclosed herein that—demonstrates an increased binding affinity for a specified insect receptor comprising a receptor polypeptide disclosed herein or selected domains thereof linked to other receptor domains to comprise a complete ligand, which has the steps of a) contacting the insect receptor with a first candidate ligand, b) measuring the binding affinity of the first candidate ligand, c) engineering the first candidate ligand to comprise a second candidate ligand with variations in the domains selected that together comprise the second candidate ligand, d) contacting the insect receptor with the second candidate ligand, and e) measuring the binding affinity of the second candidate ligand, and f) repeating steps c) through e) until a candidate ligand exhibits increased binding affinity for the insect receptor of interest.

Yet another aspect of the present invention provides methods for selecting insect toxins to combine for controlling insect populations, which have the steps of a) reducing at least one receptor of the insect toxin in a insect population, b) providing the insect population with the reduced receptor at least one insect toxin, c) assessing toxicity of the toxin in the insect population, d) optionally repeating steps ii) and iii) to assess toxicity of additional toxins, and e) selecting one toxin with reduced toxicity to combine with at least another toxin with unreduced toxicity.

One non-limiting embodiment of the present invention is using gene suppression to reduce receptor expression. Reducing the receptor expression can be done by contacting an insect population with a polynucleotide comprising at least 18 contiguous nucleotides with a sequence of about 95% to about 100% identity with a segment of equivalent length of a DNA having a sequence selected from the group consisting of SEQ ID NO: 1 through 22, 45 through 91, 139 through 142, and 149 through 167, or the DNA complement thereof.

One non-limiting embodiment of the present invention is to combine Cry3Bb and TIC1201 to control insect populations.

Another aspect of the present invention provides methods for select insect toxins to combine for controlling insect species including, but not limited to, *Trichoplusiani, Pseudoplusia* includes, *Helicoverpa zea, Spodoptera frugiperda*, and *Diabrotica virgifera virgifera*.

Yet another aspect of the present invention provides transgenic host cells co-expressing insect toxins selected by the methods provided herein. The transgenic host cells contemplated by the present invention include, but not limited to, plant cell, bacterium, or plant seed.

Fertile transgenic plants expressing a Cry protein developed and/or discovered through the methods of the current invention may be tested for insecticidal activity, and the plants showing optimal activity selected for further breeding. Methods are available in the art to assay for insect activity. Generally, the protein is mixed and used in feeding assays. See, for example Marrone et al. (1985) J. OF ECONOMIC ENTOMOLOGY 78:290-293. The present invention may be used for transformation of any plant species, including, but not limited to, monocots and dicots. Examples of plants of interest include, but are not limited to, corn (maize), soybean, rape seed, cotton, alfalfa, sugar beet, rice, sugar cane, sorghum, wheat, tomato, crucifers, peppers, potato, tobacco, barley, rye, safflower, peanuts, sweet potato, cassava, coffee, coconut, pineapple, citrus trees, banana, avocado, fig, guava, mango, olive, papaya, cashew, macadamia, almond, oats, vegetables, ornamentals, and conifers.

BRIEF DESCRIPTION OF THE DRAWINGS

FIG. 2 shows ligand blot analysis of Cry1Ab and Cry1Ac with TnCAD TBR2 and TBR3 variants. The first four lanes contain alternating replicate Maltose Binding Protein (MBP)-fused or Tobacco Vein Mottled Virus (TVMV) cleaved TnCAD TBR2 variant protein expression extracts.

The next four lanes contain alternating replicate MBP-fused or TVMV cleaved TnCAD TBR3 variant protein expression extracts. Negative control (−) contains E coli lysate without TnCAD and positive control (+) contains the tryptic core (TC) of the toxin used as the probe in the blot.

Figure 3:
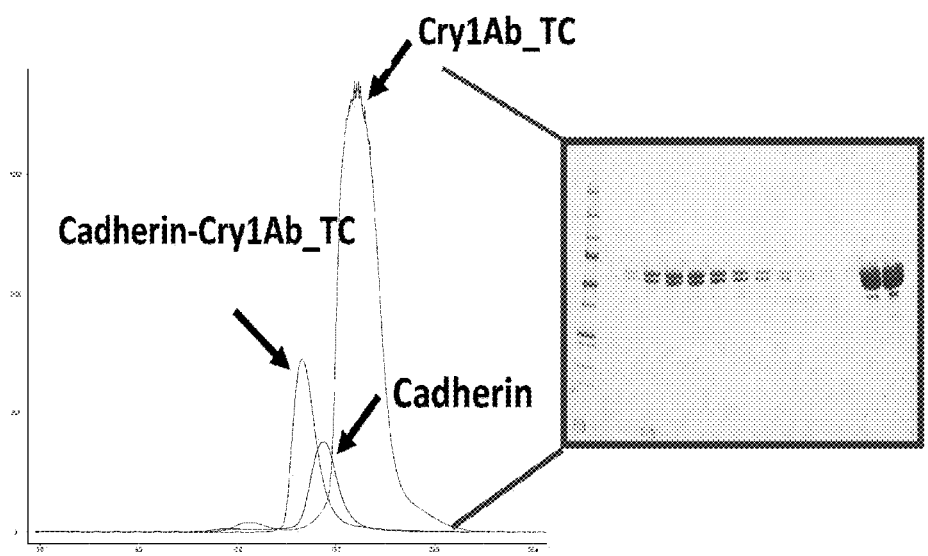
Figure 3:
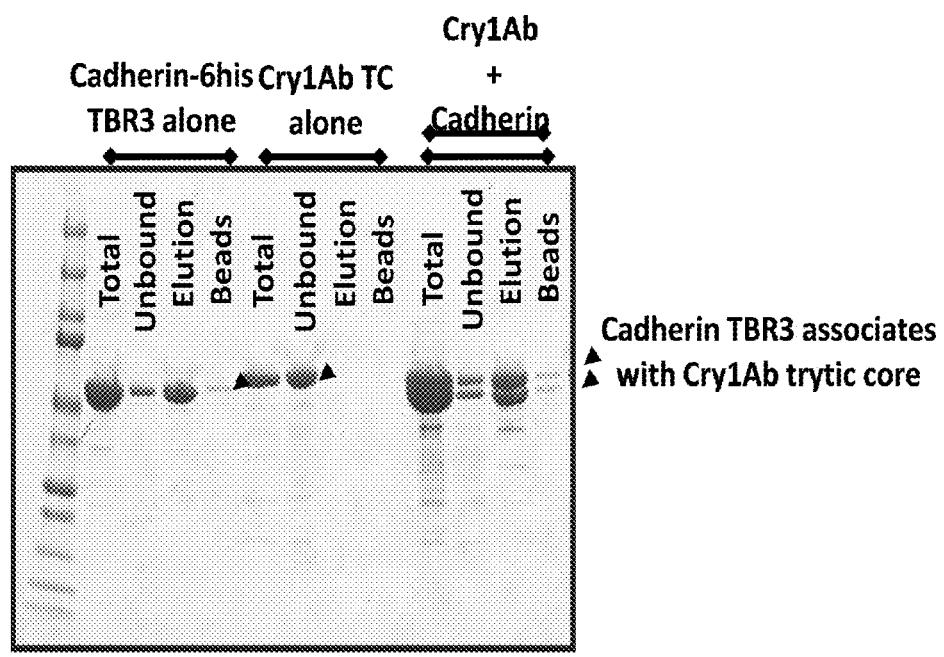
Figure 3:
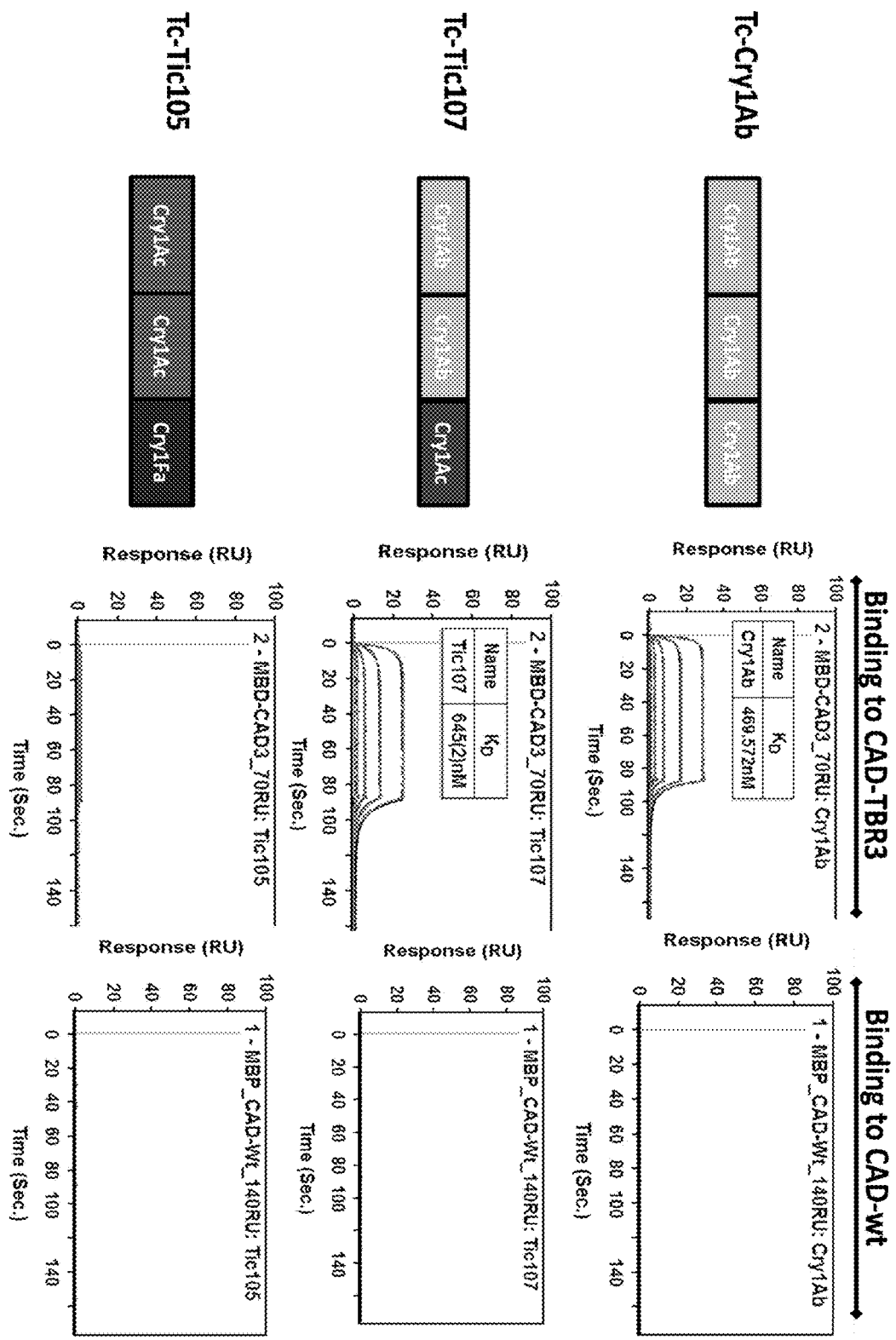

FIG. 3 shows that Cry1Ab binds to TnCAD TBR3 variant by a "pulldown" process, gel filtration and Biacore analyses. FIG. 3A shows gel filtration analysis of the Cry1Ab and TnCAD TBR3 variant complex. Inset is the SDS-PAGE gel of representative fractions for the complex. FIG. 3B shows NiNTA immobilized TnCAD TBR3 variant as bait for the tryptic core of Cry1Ab. FIG. 3C shows Biacore binding traces for immobilized TnCAD TBR3 variant with the listed toxins. CAD-TBR3 refers to the TBR3 variant form and CAD-WT refers to the corresponding wild type TnCAD fragment.

FIG. 4A illustrates the design of two truncation variants of TnCAD-TBR3 variant A (SEQ ID NO: 143), and B (SEQ ID NO: 144). FIG. 4B shows that gel filtration analysis demonstrating that TnCAD-TBR3 variant A with only the membrane proximal domain (MPD) was co-eluted with Cry1Ab toxin in peak4. Peaks 1 and 2 are Cry1Ab and TnCad-TBR variant B alone respectively as controls. FIG. 4C shows that gel filtration analysis demonstrating that TnCAD-TBR3 variant B with only a truncated membrane proximal domain (MPD) was co-eluted with Cry1Ab toxin in peak2.

Figure 5:
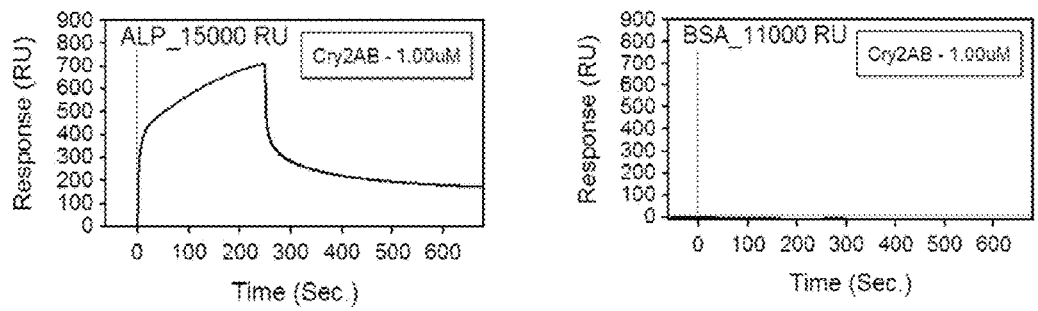
Figure 5:
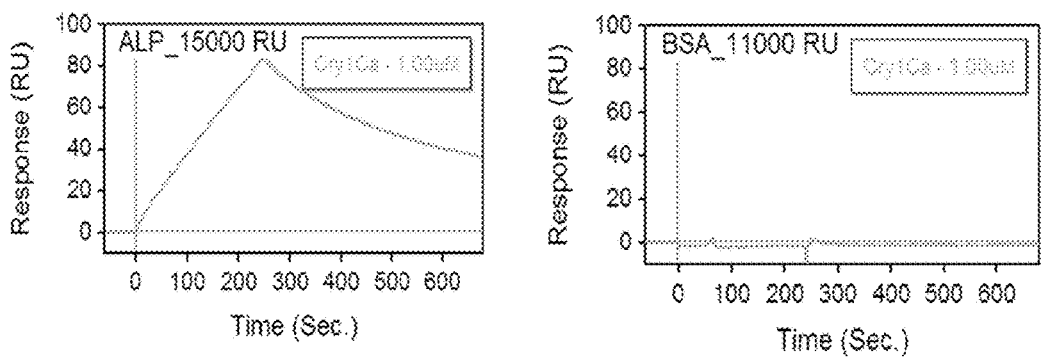
Figure 5:
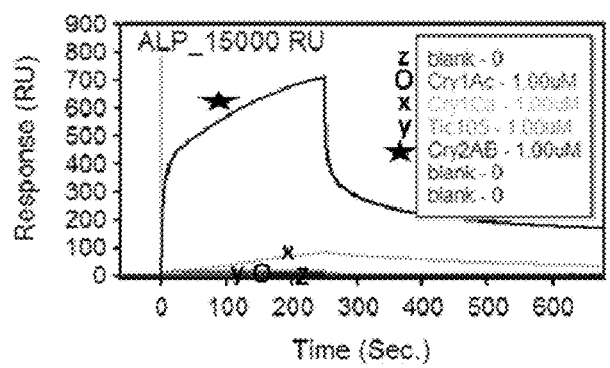

FIG. 5 illustrates that SPR experiments were performed using a Biacore T000 instrument for SfALP and various toxins with BSA as the running buffer and control. FIG. 5A shows the binding characteristics of SfALP to Cry2AB. FIG. 5B shows the binding characteristics of ALP to Cry1Ca. FIG. 5C shows while Cry2AB and Cry1Ca bind to SfALP, Cry1AC and Tic105 do not bind to SfALP.

Figure 6:
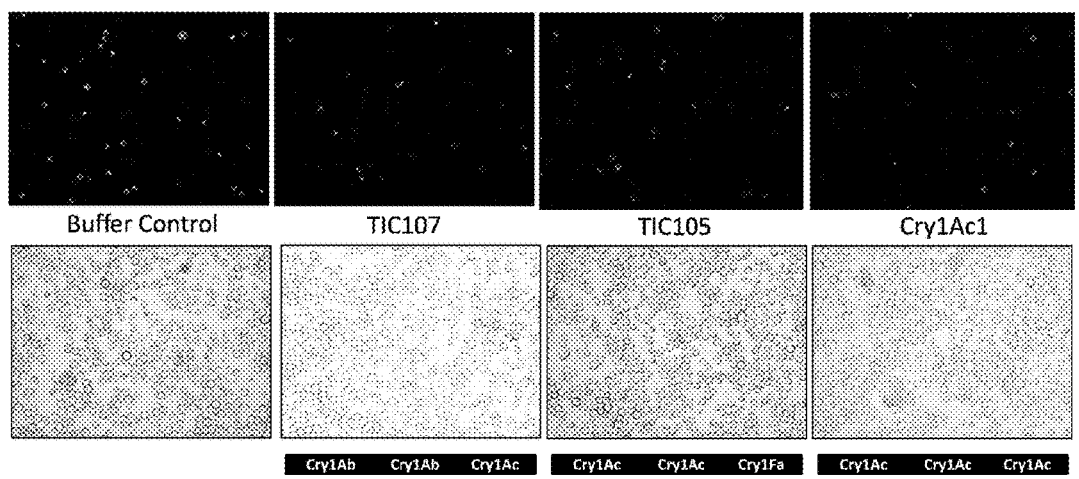
Figure 6:
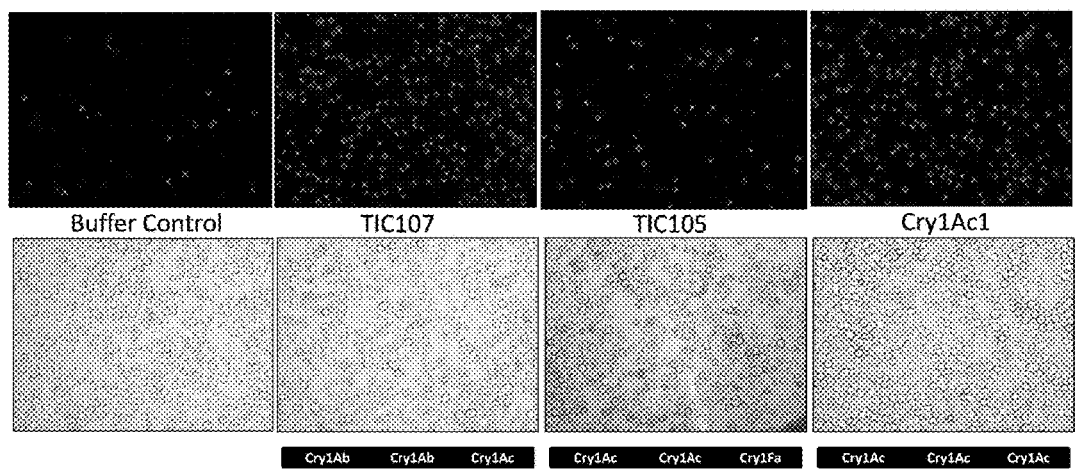
Figure 6:
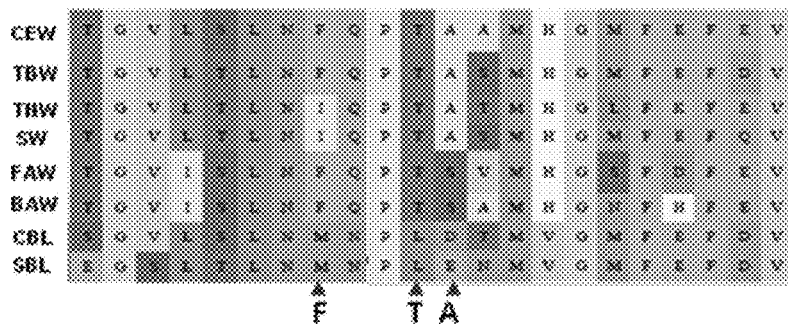

FIG. 6 shows that PiCAD TBR3 variant resulted in cell sensitivity to Cry1Ac and TIC107. FIG. 6A shows the effect of toxin challenge on SF9 cells expressing the WT PiCAD full length coding sequence. FIG. 6B shows the effect of toxin challenge on SF9 cells expressing the PiCAD TBR3 variant. FIG. 6C shows the amino acid changes introduced into PiCAD TBR3 variant provided by the present invention.

Figure 7:
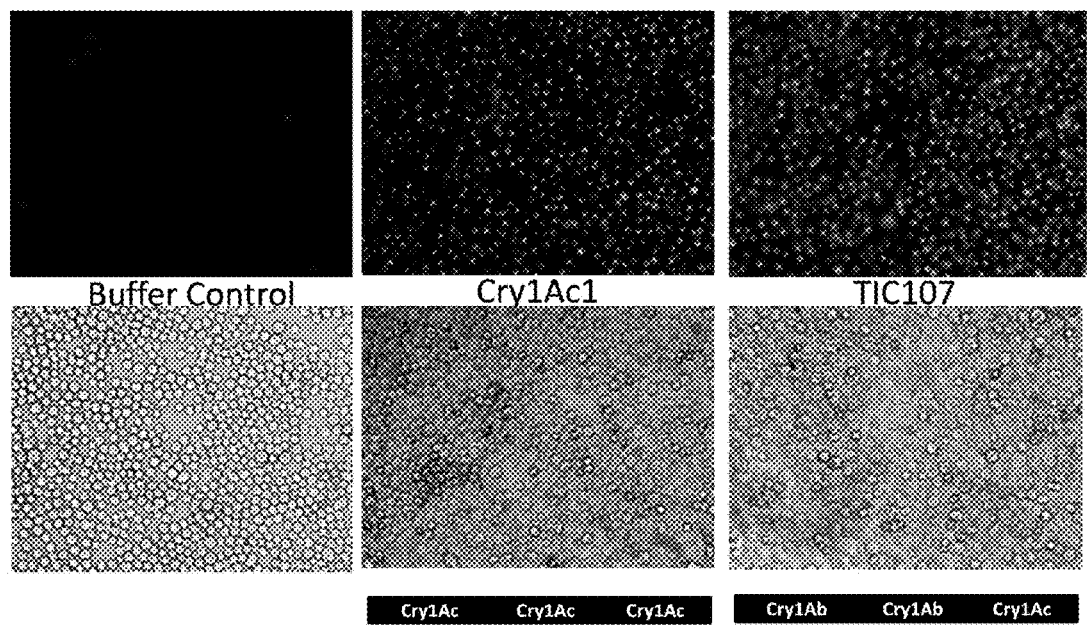
Figure 7:
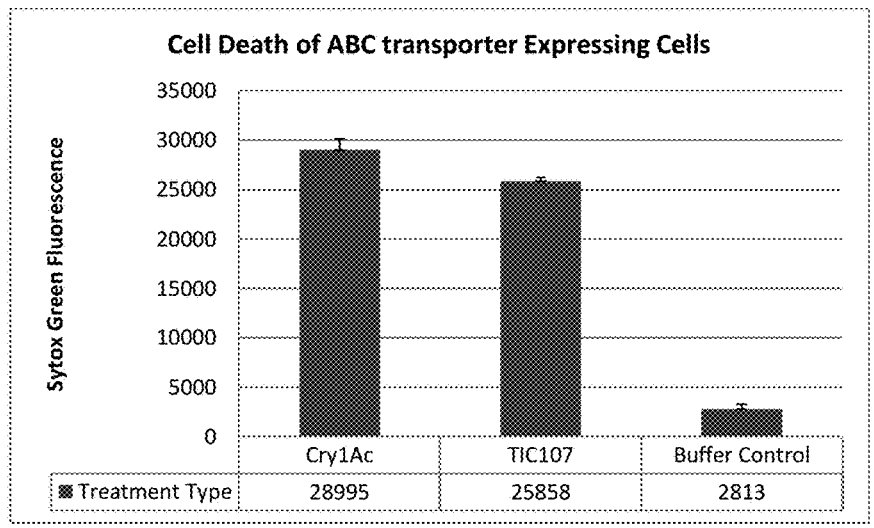

FIG. 7 shows that Spodoptera frugiperda ABC transporter is a functional receptor for Cry1A toxins. FIG. 7A shows that SF9 cells expressing ABC transporter are sensitive to 50 ppm of tryptic cores for Cry1Ac1 and TIC107. Upper panels show the sytox green staining signal and lower panels show the bright field image of the corresponding region. FIG. 7B shows the quantification of cell toxicity response as measured by a sytox green signal.

Figure 8:
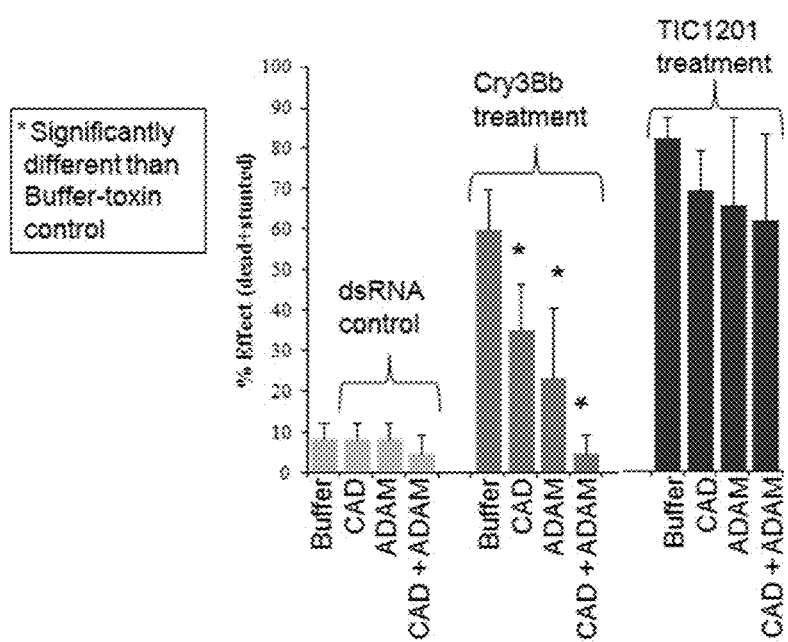

FIG. 8 shows that suppressing either Cadherin or ADAM metalloprotease in Western corn rootworm by dsRNA conferred Cry3Bb resistance measured by reduced mortality or 2nd/3rd-instar stunting on the tenth day while TIC1201 remained effective, and that suppressing both Cadherin and ADAM metalloprotease simultaneously had a synergistic effect in conferring Cry3Bb resistance.

BRIEF DESCRIPTION OF THE SEQUENCES

NUC SEQ ID in Table 1 is the sequence number of the recombinant DNA in the sequence listing PEP SEQ ID in Table 1 is the sequence number of the recombinant polypeptide in the sequence listing

TABLE 1

| Gene Identifier | NUC SEQ ID | PEP SEQ ID | Annotation |
| --- | --- | --- | --- |
| Trichoplusia_ni_ALP1 | 1 | 23 | Alkaline phosphatase |
| Trichoplusia_ni_APN1 | 2 | 24 | Aminopeptidase |
| Trichoplusia_ni_APN6 | 3 | 25 | Aminopeptidase |
| Trichoplusia_ni_Cadherin_D01 | 4 | 26 | cadherin like protein |
| Trichoplusia_ni_Cadherin_E02 | 5 | 27 | cadherin like protein |
| Trichoplusia_ni_Cadherin_TBR3_CR9-TMD | 6 | 28 | cadherin variant |
| Pseudoplusia_includens_APN1 | 7 | 29 | Aminopeptidase |
| Pseudoplusia_includens_Cadherin_clone A01 | 8 | 30 | cadherin like protein |
| Pseudoplusia_includens_Cadherin_clone C01 | 9 | 31 | cadherin like protein |
| Pseudoplusia_includens_Cadherin_clone C01-TBR3variant | 10 | 32 | cadherin variant |
| Helicoverpa_zea_APN1 | 11 | 33 | Aminopeptidase |
| Helicoverpa_zea_ALP1 | 12 | 34 | Alkaline phosphatase |
| Helicoverpa_zea_ALP2 | 13 | 35 | Alkaline phosphatase |
| Helicoverpa_zea_APN3 | 14 | 36 | Aminopeptidase |
| Spodoptera_frugiperda_ABC_transporter | 15 | 37 | ABC transporter |
| Spodoptera_frugiperda_Alkaline_phosphatase_1 | 16 | 38 | Alkaline phosphatase |
| Spodoptera_frugiperda_Aminopeptidase_N1 | 17 | 39 | Aminopeptidase |
| Diabrotica_virgifera_virgifera_ADAM_metalloprotease_v1 | 18 | 40 | ADAM metalloprotease |
| Diabrotica_virgifera_virgifera_ADAM_metalloprotease _v2 | 19 | 41 | ADAM metalloprotease |
| Diabrotica_virgifera_virgifera_ADAM_metalloprotease_Vn | 20 | 42 | ADAM metalloprotease |
| Diabrotica_virgifera_virgifera_ABC_transporter_Vn | 21 | 43 | ABC transporter |
| Diabrotica_virgifera_virgifera_APN2 | 22 | 44 | Aminopeptidase |
| Diabrotica_virgifera_virgifera_ABC_transporter_105_10 | 45 | 92 | ABC transporter |
| Diabrotica_virgifera_virgifera_ABC_transporter_105_9 | 46 | 93 | ABC transporter |
| Diabrotica_virgifera_virgifera_ABC_transporter_218_1 | 47 | 94 | ABC transporter |
| Diabrotica_virgifera_virgifera_ABC_transporter_218_2 | 48 | 95 | ABC transporter |
| Diabrotica_virgifera_virgifera_ABC_transporter_218_3 | 49 | 96 | ABC transporter |
| Diabrotica_virgifera_virgifera_ABC_transporter_218_4 | 50 | 97 | ABC transporter |
| Diabrotica_virgifera_virgifera_Aminopeptidase_837_1 | 51 | 98 | Aminopeptidase |
| Diabrotica_virgifera_virgifera_Aminopeptidase_837_2 | 52 | 99 | Aminopeptidase |
| Diabrotica_virgifera_virgifera_Aminopeptidase_871_1 | 53 | 100 | Aminopeptidase |
| Diabrotica_virgifera_virgifera_cadherin_1083_1 | 54 | 101 | cadherin like protein |
| Diabrotica_virgifera_virgifera_cadherin_1817_1 | 55 | 102 | cadherin like protein |
| Diabrotica_virgifera_virgifera_ABC_transporter_01859_1 | 56 | 103 | ABC transporter |
| Diabrotica_virgifera_virgifera_ABC_transporter_01867_1 | 57 | 104 | ABC transporter |
| Diabrotica_virgifera_virgifera_ABC_transporter_01873_1 | 58 | 105 | ABC transporter |
| Diabrotica_virgifera_virgifera_Aminopeptidase_01949_1 | 59 | 106 | Aminopeptidase |
| Diabrotica_virgifera_virgifera_ADAM_metalloprotease_01952_1 | 60 | 107 | ADAM metalloprotease |
| Diabrotica_virgifera_virgifera_Aminopeptidase_02024_1 | 61 | 108 | Aminopeptidase |
| Diabrotica_virgifera_virgifera_Aminopeptidase_02031_1 | 62 | 109 | Aminopeptidase |
| Diabrotica_virgifera_virgifera_ | 63 | 110 | Aminopeptidase |

TABLE 1-continued

| Gene Identifier | NUC SEQ ID | PEP SEQ ID | Annotation |
| --- | --- | --- | --- |
| Aminopeptidase_02119_1 | | | |
| Diabrotica_virgifera_virgifera_ADAM_metalloprotease_02122_1 | 64 | 111 | ADAM metalloprotease |
| Diabrotica_virgifera_virgifera_Aminopeptidase_02140_1 | 65 | 112 | Aminopeptidase |
| DIADiabrotica_virgifera_virgifera_Aminopeptidase_02340_1 | 66 | 113 | Aminopeptidase |
| Diabrotica_virgifera_virgifera_ABC_transporter_02470_1 | 67 | 114 | ABC transporter |
| Diabrotica_virgifera_virgifera_ABC_transporter_02630_1 | 68 | 115 | ABC transporter |
| Diabrotica_virgifera_virgifera_ALP_02713_1 | 69 | 116 | Alkaline phosphatase |
| Diabrotica_virgifera_virgifera_Aminopeptidase_03898_1 | 70 | 117 | Aminopeptidase |
| Diabrotica_virgifera_virgifera_ADAM_metalloprotease_04620_1 | 71 | 118 | ADAM metalloprotease |
| Diabrotica_virgifera_virgifera_ADAM_metalloprotease_04627_1 | 72 | 119 | ADAM metalloprotease |
| Diabrotica_virgifera_virgifera_Aminopeptidase_04697_1 | 73 | 120 | Aminopeptidase |
| Diabrotica_virgifera_virgifera_Aminopeptidase_04881_1 | 74 | 121 | Aminopeptidase |
| Diabrotica_virgifera_virgifera_cadherin_04907_1 | 75 | 122 | cadherin |
| Diabrotica_virgifera_virgifera_Aminopeptidase_05042_1 | 76 | 123 | Aminopeptidase |
| Diabrotica_virgifera_virgifera_ADAM_metalloprotease_05390_1 | 77 | 124 | ADAM metalloprotease |
| Diabrotica_virgifera_virgifera_ABC_transporter_05581_1 | 78 | 125 | ABC transporter |
| Diabrotica_virgifera_virgifera_ADAM_metalloprotease_05844_1 | 79 | 126 | ADAM metalloprotease |
| Diabrotica_virgifera_virgifera_ABC_transporter_06637_1 | 80 | 127 | ABC transporter |
| Diabrotica_virgifera_virgifera_ADAM_metalloprotease_07383_1 | 81 | 128 | ADAM metalloprotease |
| Diabrotica_virgifera_virgifera_ABC_transporter_07661_1 | 82 | 129 | ABC transporter |
| Diabrotica_virgifera_virgifera_ADAM_metalloprotease_08650_1 | 83 | 130 | ADAM metalloprotease |
| Diabrotica_virgifera_virgifera_Aminopeptidase_08778_1 | 84 | 131 | Aminopeptidase |
| Diabrotica_virgifera_virgifera_Aminopeptidase_08810_1 | 85 | 132 | Aminopeptidase |
| Diabrotica_virgifera_virgifera_Aminopeptidase_09768_1 | 86 | 133 | Aminopeptidase |
| Diabrotica_virgifera_virgifera_cadherin_10167_1 | 87 | 134 | cadherin like protein |
| Diabrotica_virgifera_virgifera_ADAM_metalloprotease_10594_1 | 88 | 135 | ADAM metalloprotease |
| Diabrotica_virgifera_virgifera_ABC_transporter_11225_12? | 89 | 136 | ABC transporter |
| Diabrotica_virgifera_virgifera_ABC_transporter_11255_1 | 90 | 137 | ABC transporter |
| Diabrotica_virgifera_virgifera_cadherin_01803_1 | 91 | 138 | cadherin like protein |
| Tn CAD variant A | 139 | 143 | Cadherin variant TBR |
| Tn CAD variant B | 140 | 144 | Cadherin variant TBR |
| CRW ABC transporter TBR | 141 | 145 | ABC transporter TBR |
| APN2 TBR frag 9 | 142 | 146 | Aminopeptidase TBR |
| dsRNA for cadherin | 147 | / | / |
| dsRNA for ADAM metalloprotease | 148 | / | / |
| DsABCc2 | 149 | 168 | ABC transporter |
| DsABCc3 | 150 | 169 | ABC transporter |
| DvABCa3 | 151 | 170 | ABC transporter |
| DvABCc1 | 152 | 171 | ABC transporter |
| HzABCa7 | 153 | 172 | ABC transporter |
| HzABCb1 | 154 | 173 | ABC transporter |
| PiABCb1 | 155 | 174 | ABC transporter |
| PiABCc2 | 156 | 175 | ABC transporter |
| PiABCc3 | 157 | 176 | ABC transporter |
| SfABCa3 | 158 | 177 | ABC transporter |
| SfABCb1 | 159 | 178 | ABC transporter |
| SfABCb5 | 160 | 179 | ABC transporter |
| SfABCc1 | 161 | 180 | ABC transporter |
| SfABCc2 | 162 | 181 | ABC transporter |
| SfABCc4 | 163 | 182 | ABC transporter |
| SfABCc5 | 164 | 183 | ABC transporter |
| SfABCg2 | 165 | 184 | ABC transporter |
| HzABCc2 | 166 | 185 | ABC transporter |
| HzABCc3 | 167 | 186 | ABC transporter |

DETAILED DESCRIPTION OF THE INVENTION

Disclosed herein are receptor polypeptides isolated from various insects that are involved in Bt toxin binding including those derived from the Lepidopteran superfamily, e.g. from the species *Trichoplusia ni*(Tn), *Pseudoplusia includes* (Pi), *Helicoverpa zea*, and *Spodoptera frugiperda* (Sf), and those derived from the Coleopteran superfamily, e.g. from the species *Diabrotica virgifera virgifera*. These receptor polypeptides have homology to sequences present in cadherin, ABC transporter, Alkaline phosphatase, ADAM metalloprotease and/or Aminopeptidase sequences. In particular, provided herein are recombinant polypeptides comprising an amino acid sequence as set for in SEQ ID NOs: 23 through 44, 92 through 138, 143 through 146, and 168 through 186 listed in Table 1, or, fragments or fusions thereof in which non-essential, or not relevant, amino acid residues have been added, replaced, or deleted. Further provided are recombinant DNA comprising a nucleotide sequence as set forth in SEQ ID NOs: 1 through 22, 45 through 91, 139 through 142, and 149 through 167 listed in Table 1.

In the context of the present invention, a homologous sequence is taken to include an amino acid sequence which is at least 60, 70, 80 or 90% identical, at least 91%, 92%, 93%, 94%, 95%, 96%, 97%, 98%, 99%, or 99.5% identical, or identical to any fraction percentage in this range at the amino acid level over at least 20, 50, 100, 200, 300 or 400 amino acids with the amino acid sequences set forth in SEQ ID NOs: 23 through 44, 92 through 138, 143 through 146, and 168 through 186. In particular, homology should typically be considered with respect to those regions of the sequence known to be essential for the function of the protein such as the ligand binding region as set forth in SEQ ID NO:137 through SEQ ID NO: 140. Recombinant polypeptides of the present invention also comprise a contiguous sequence having greater than 60, 70, 80 or 90% homology, or greater than 91%, 92%, 93%, 94%, 95%, 96%, 97%, 98%, 99% or 99.5% homology, to one or more of amino acids of SEQ ID NOs: 23 through 44, 92 through 138, 143 through 146, and 168 through 186.

Disclosed herein, the term "recombinant" indicates that the material (e.g., a cell, a nucleic acid, polypeptide or a protein) has been artificially or synthetically (non-naturally) altered by human intervention. The alteration can be performed on the material within or removed from, its natural environment or state. For example, a "recombinant DNA" is one that is made by recombining nucleic acids, e.g., during cloning, DNA shuffling or other procedures; a "recombinant polypeptide" or "recombinant protein" may be a polypeptide or protein which is produced by expression of a recombinant nucleic acid.

The recombinant DNA and polypeptide disclosed herein encompass protein variants, or fragments thereof. In one embodiment, protein variants include any amino acid polymers in which one or more amino acid residue is an artificial chemical analogue of a corresponding naturally occurring amino acid, as well as to any naturally occurring amino acid polymers. The nature of such analogues of naturally occurring amino acids is that, when incorporated into a protein that protein is specifically reactive to antibodies elicited to the same protein but consisting entirely of naturally occurring amino acids. In another embodiment of the invention, protein variants are generated by deletions and insertions. A protein "fragment" is a peptide or polypeptide molecule whose amino acid sequence comprises a subset of the amino acid sequence of that protein. Specifically a fragment of a Bt toxin receptor refers to the biologically active portion of a Bt toxin receptor polypeptide. In another embodiment, these protein variants and fragments continue to possess the desired toxin binding activity.

It is known in the art that proteins or polypeptides may undergo posttranslational modification, including but not limited to, disulfide bond formation, gamma-carboxylation of glutamic acid residues, glycosylation, lipid attachment, phosphorylation, oligomerization, hydroxylation and ADP-ribosylation. Modifications can occur anywhere in a polypeptide, including the peptide backbone, the amino acid side-chains and the amino or carboxyl termini. Blockage of the amino or carboxyl group in a polypeptide, or both, by a covalent modification, is known in naturally occurring and synthetic polypeptides and such modifications can be present in polypeptides of the present invention, as well. For instance, the amino terminal residue of polypeptides made in *E. coli* or other cells, prior to proteolytic processing, almost invariably will be N-formylmethionine. During post-translational modification of the polypeptide, a methionine residue at the NH2 terminus can be deleted. Accordingly, contemplated is the use of both the methionine-containing and the methionine-less amino terminal variants of the protein disclosed herein.

In one embodiment, provided herein is the use of structural information for the design and production of variant receptors that have altered binding properties and/or specificities to known toxins. In a specific embodiment, the present invention provides the variant receptors, for example, as set for in SEQ ID NO: 28 and 32. The variants or modified forms of receptors disclosed herein may be prepared in a number of ways. For example, the wild-type receptor sequence can be mutated in those sites identified using the present invention as desirable for mutation, by means of site directed mutagenesis by PCR, oligonucleotide-directed mutagenesis or other conventional methods well known to the person skilled in the art. Amino acid substitutions, deletions and/or insertions can readily be made using peptide synthetic techniques well known in the art, such as solid phase peptide synthesis and the like, or by recombinant DNA manipulation. Methods for the manipulation of DNA sequences to produce substitution, insertion or deletion variants of a protein are known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Disclosed herein, the term "domain" refers to a set of amino acids conserved at specific positions along an alignment of sequences of evolutionarily related proteins. Specialist databases exist for the identification of domains, for example, SMART (Schultz et al. (1998) PROC. NATL. ACAD. SCI. USA 95, 5857-5864; Letunic et al. (2002) Nucleic Acids Res 30, 242-244), InterPro (Mulder et al. (2003) NUCL. ACIDS. RES. 31, 315-318), Prosite (Bucher and Bairoch (1994), or Pfam (Bateman et al. (2002) NUCLEIC ACIDS RESEARCH 30(1): 276-280). A set of tools for in silico analysis of protein sequences is available on the ExPASy proteomics server (Swiss Institute of Bioinformatics (Gasteiger et al. (2003) ExPASy: the proteomics server for in-depth protein knowledge and analysis, NUCLEIC ACIDS RES. 31:3784-3788). Domains or motifs can also be identified using techniques known in the art, such as by sequence alignment. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

A polypeptide or fragment thereof that comprises one or more additional peptide regions not derived from that protein is a "fusion" protein. Such molecules can be derivatized to contain carbohydrate or other moieties (such as keyhole limpet hemocyanin, etc.). Fusion proteins or peptide molecules of the present invention can be produced via recombinant means.

In another embodiment, one or more of the polypeptide or fragment of peptide molecules can be produced via chemical synthesis, or by expressing in a suitable prokaryotic or eukaryotic host. Methods for expression are described by Sambrook, et al., (In: MOLECULAR CLONING, A LABORATORY MANUAL, 2nd Edition, Cold Spring Harbor Press, Cold Spring Harbor, N.Y. (1989)).

Another aspect of the present invention relates to antibodies, single-chain antigen binding molecules, or other proteins that specifically bind to one or more of the protein or recombinant polypeptide disclosed herein and their homologues, fusions or fragments. Such antibodies can be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules. In an embodiment, the antibodies bind to proteins disclosed herein.

Nucleic acid molecules that encode all or part of the recombinant polypeptide disclosed herein can be expressed, via recombinant means, to yield protein or peptides that can in turn be used to elicit antibodies that are capable of binding the expressed protein or peptide. Such antibodies can be used in immunoassays for that protein. Such protein-encoding molecules, or their fragments may be a "fusion" molecule (e.g., a part of a larger nucleic acid molecule) such that, upon expression, a fusion protein is produced. It is understood that any of the nucleic acid molecules disclosed herein can be expressed, via recombinant means, to yield proteins or polypeptides encoded by these nucleic acid molecules.

The antibodies that specifically bind proteins and protein fragments of the present invention can be polyclonal or monoclonal, and can comprise intact immunoglobulins, or antigen binding portions of immunoglobulins (such as (F(ab'), F(ab')2) fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In Antibodies: A Laboratory Manual, Cold Spring Harbor Press, Cold Spring Harbor, N.Y. (1988)).

In an embodiment, such antibody molecules or their fragments can be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or polypeptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

In an embodiment, disclosed herein are recombinant DNA vectors in prokaryotic or eukaryotic hosts or cells. The recombinant DNA vectors contemplated herein include those for cloning, expression and transformation vectors. The recombinant DNA vector prepared for introduction into a prokaryotic or eukaryotic host typically comprise a replication system (e.g. vector) recognized by the host, including the DNA fragment encoding the recombinant polypeptide disclosed herein, and will preferably also include transcription and translational initiation regulatory sequences operably linked to the polypeptide-encoding segment. A non-limiting example for expression systems (expression vectors) can include an origin of replication or autonomously replicating sequence (ARS) and expression control sequences, a promoter, an enhancer and necessary processing information sites, such as ribosome-binding sites, RNA splice sites, polyadenylation sites, transcriptional terminator sequences, and mRNA stabilizing sequences. Signal peptides can also be included where appropriate from secreted polypeptides of the same or related species, which allow the protein to cross and/or lodge in cell membranes or be secreted from the cell.

In another embodiment, expression and transformation vectors can contain a selectable marker, that is, a gene encoding a protein necessary for the survival or growth of a host cell transformed with the vector. Although such a marker gene may be carried on another polynucleotide sequence co-introduced into the host cell, it is most often contained on the cloning vector. Only those host cells into which the marker gene has been introduced survive and/or grow under selective conditions. Typically selection genes encode proteins that (a) confer resistance to antibiotics or other toxic substances, e.g., ampicillin, neomycin, methotrexate, etc.; (b) complement auxotrophic deficiencies; or (c) supply critical nutrients not available from complex media. The choice of the selectable marker depends on the host cell; appropriate markers for different hosts are known in the art.

The term "operably linked", as used herein, refers to a functional linkage between at least two expression regulatory elements, such as, but not limited to the functional linkage between promoter sequence and gene of interest, such that the promoter sequence is able to initiate transcription of the gene of interest. Another such non-limiting example is the functional linkage between signal peptide and gene of interest.

Another embodiment of the present invention relates to transgenic cells or organisms transformed with recombinant DNA encoding Bt toxin receptor disclosed herein. The transgenic organisms or cells can be either prokaryotic or eukaryotic, for examples, insect, yeast, bacteria, phage, and fungus. The terms "transformation", as used herein, also encompassing transfection, conjugation and transduction, include a multiplicity of publicly known methods for introducing recombinant DNA into a host cell, including calcium phosphate or calcium chloride co-precipitation, DEAE-dextran-mediated transfection, lipofectin, cellfectin, natural competence, chemically mediated transfer, electroporation or particle bombardment. Methods suitable for transforming or transfecting host cells can be found in Sambrook et al. (MOLECULAR CLONING: A LABORATORY MANUAL., 2nd edition, Cold Spring Harbor Laboratory, Cold Spring Harbor Laboratory Press, Cold Spring Harbor, N.Y., 1989) and other laboratory manuals such as METHODS IN MOLECULAR BIOLOGY, 1995, vol. 44, *Agrobacterium* protocols, eds: Gartland and Davey, Humana Press, Totowa, N.J. Transformation encompassing transfection, conjugation and transduction can be either transient or stable transformation. It is known about stable or transient integration of recombinant DNA that, depending on the expression vector used and transformation technique. For example, Baculovirus vectors available for expression of proteins in cultured insect cells (e.g. Sf9 cells) include the pAc series (Smith et al. (1983) MOL. CELL BIOL. 3:2156) and the pVL series (Lucklow et al. (1989) Virology 170:31), as well as commercially available derivatives.

Further provided herein are methods utilizing Bt toxin receptor disclosed herein to screen for candidate ligands for that receptor. Examples for such ligands include, but are not limited to, natural and modified toxins, pesticides, antibodies, peptides, receptor agonists and antagonists, and other small molecules or domains (or segments) of known toxins designed or deduced to interact with the receptors disclosed herein. Candidate ligands include molecules available from diverse libraries of small molecules created by combinatorial synthetic methods. In addition to screening for candidate ligands, the screen can be used to screen engineered toxins for improved forms containing domains (or segments) from various sources which can be more specific or less specific to particular classes of insects as desired, or can be more potent in killing a specific class of insects, or can be effective in killing a class of insects with established resistance to Bt existing toxins. The methods of engineering a Bt toxin include, but not limited to, those protein design methods involving mutagenesis (Smith et al. (1994) BIOCHEM. J. 302:611-616 and Wu et al. (2000) FEBS Lett. 473:227-232), deletion (Tabashnik et al. (2011) NATURE BIOTECHNOLOGY 29: 1128-1131), addition, and domain substitution (Maagd et al. (1996) APPL ENVIRON MICROBIOL. 62(5): 1537-1543). Furthermore, engineering toxin variants and screening for improved forms can be carried out in a high throughput manner.

In one embodiment, the method disclosed herein comprise providing a Bt toxin receptor in binding assays to determine differences between at least two toxins or variants of the same toxin. Non-limiting examples are the reconstitution of receptors in Brush Border Membrane Vesicles (BBMV) and their application in binding assays such as ligand blot, binding in solution, light scattering or Surface Plasmon Resonance, to obtain kinetic parameters, such as association/disassociation rates, binding affinity, binding site specificity and to obtain information if Bt toxin binding is reversible or irreversible.

In another embodiment, insect receptors are used for structure-function analysis. One such example is the identification of putative binding regions in the toxin and receptor to design new toxin variants with stronger binding, broad spectrum of binding, or different specificity.

In yet another embodiment identified receptor sequences, or fragments thereof, are used as markers for identifying changes in allele frequencies of different populations by determining different haplotypes and the frequency of appearance. As used herein "haplotype" is a combination of alleles at adjacent locations on a chromosome that are inherited together. A haplotype may be one locus, several loci, or an entire chromosome.

In one embodiment, the methods disclosed herein comprise providing at least one Bt toxin receptor, contacting the Bt toxin receptor with a sample containing a ligand candidate under conditions promoting binding, and determining the binding characteristics or the viability of the cell expressing the Bt toxin receptor on cell surface.

As used herein, the term "conditions promoting binding" refers to any combination of physical and biochemical conditions that enables a ligand to detectably bind the intended receptor polypeptide disclosed herein over background levels. "Detectably binding" as used herein refers to sensing of receptor binding by various means, including, but not limited to, loss of toxin function by feeding or injection of a target pest with one or more dsRNA targeting for suppression of a particular receptor or receptor ligand. Examples of such conditions for binding of Cry1 toxins to Bt toxin receptors, as well as methods for assessing the binding, are known in the art and include, but are not limited to, those described in Keeton et al. (1998) APPL ENVIRON MICROBIOL 64(6): 2158-2165; Francis et al. (1997) INSECT BIOCHEM MOL BIOL 27(6):541-550; Keeton et al. (1997) APPL ENVIRON MICROBIOL 63(9):3419-3425; Vadlamudi et al. (1995) J Biol Chem 270(10):5490-5494; Ihara et al. (1998) COMPARATIVE BIOCHEMISTRY AND PHYSIOLOGY, PART B 120:197-204; and Nagamatsu et al. (1998) BIOSCI. BIOTECHNOL. BIOCHEM. 62(4):727-734.

In yet another embodiment, the screening assays can be whole organism, intact cell or in vitro assays which include exposing a ligand binding region or domain to a sample ligand and detecting the formation of a ligand-receptor complex. A ligand binding region is the amino acid fragment of a receptor that binds a ligand. A ligand binding region can be a fragment of a ligand binding domain. The assays could be direct ligand-receptor binding assays or ligand competition assays.

Methods are known for studying protein-protein interactions, such as yeast and/or bacterial two-hybrid systems (for example, CLONTECH (Palo Alto, Calif.) or Display Systems Biotech Inc. (Vista, Ca)), surface plasmon resonance (SPR, Richard B M Schasfoort and Anna J Tudos (2008). *Handbook of Surface Plasmon Resonance*), co-immunoprecipitation (Phizicky E. M. and Fields S. (1995) Protein-protein interactions: Methods for detection and analysis. MICROBIOL REV. 59, 94-123.), pull-down assays (Einarson, M. B. (2001). Detection of Protein-Protein Interactions Using the GST Fusion Protein Pulldown Technique. IN MOLECULAR CLONING: A LABORATORY MANUAL, 3rd Edition, Cold Spring Harbor Laboratory Press, pp. 18.55-18.59) and phage display (Sachdev S Sidhu et al. Exploring protein-protein interactions with phage display. CHEMBIOCHEM. 2003 Jan. 3; 4(1):14-25) and can be used for determining ligand-receptor binding.

For in-vitro binding assays, the polypeptide can be provided as isolated, lysed, or homogenized cellular preparations. Isolated polypeptides can be provided in solution, or immobilized to a matrix. Methods for immobilizing polypeptides are known in the art, and include, but are not limited to, construction and use of fusion polypeptides with commercially available high affinity ligands. For example, GST fusion proteins can be adsorbed onto glutathione sepharose beads (Sigma Chemical, St. Louis, Mo.) or glutathione derivatized microtitre plates. The polypeptides can also be immobilized utilizing well techniques in the art utilizing conjugation of biotin and streptavidin. The polypeptides can also be immobilized utilizing known techniques in the art utilizing chemical conjugation (linking) of polypeptides to a matrix. Alternatively, the polypeptides can be provided in intact cell binding assays in which the polypeptides are generally expressed as cell surface Bt toxin receptors.

In another embodiment, provided herein are methods utilizing intact cell toxicity assays to screen for ligands that bind to Bt toxin receptor described herein and confer toxicity upon a cell of interest expressing the Bt toxin receptor. A ligand selected by this screening can be a potential insecticidal toxin to insects expressing the receptor polypeptides, particularly enterally. The toxicity assays include exposing, in intact cells expressing a receptor polypeptide of the invention, the toxin binding region, domain or segment of the polypeptide to a sample ligand and detecting the toxicity affected in the cell expressing the receptor polypeptide. The term "toxicity" refers to the decreased viability of a cell. The term "viability" refers to the ability of a cell to proliferate and/or differentiate and/or maintain its biological characteristics in a manner characteristic of that cell in the absence of a particular cytotoxic agent.

Yet in another embodiment, toxicity, binding and permeability can be analyzed using BBMV prepared from insect midgut expressing the Bt toxin receptor provided by the present invention. The BBMV preparation and its uses in various assays are known in the art, for example as described in Wolfersberger et al. (1987) COMPARATIVE BIOCHEMISTRY AND PHYSIOLOGY A 86, 301-308 and Luo et al. (1999) APPL ENVIRON MICROBIOL. 65(2): 457-464. The insects used to prepare for BBMV can be transgenic insects expressing Bt toxin receptor provided by the present invention. Permeability derived from the BBMV based assay can be used as an index for the toxicity of a toxin for insect cells expressing the same Bt toxin receptor.

Yet in another embodiment, provided herein are methods to assess and compare the binding affinities of at least two candidate ligands for a Bt toxin receptor. In order to prevent or delay the onset of insects developing resistance against toxins and pesticides, new candidate ligands having (or exhibiting) different Mode-of-Action, herein called MOA, are needed. A different MOA can present itself in various ways; for example novel candidate ligands can bind to different insect receptors than the toxins or pesticides currently in use. Discovery of novel insecticidal toxins that bind to at least one different receptor compared to another toxin, are amenable for use as insecticides that prevent or delay the onset of insect resistance development. Several methods can be used to compare the MOA of one toxin to another. One non-limiting example includes the use of competition assays between the receptor binding of a candidate ligand and a toxin. Alternatively, as an embodiment of the present invention, interfering a toxin and its receptor interaction by different methods, such as reducing receptor expression by gene suppression in insects, can be used to differentiate toxin MOA. RNAi methods for gene suppression in insects have been described in Baum J A, et al. (2007) (Control of coleopteran insect pests through RNA interference. Nat Biotechnol 25: 1322-1326) and US20090307803. Candidate ligands with different MOA can be stacked or combined with other toxins in a transformation vector to bestow transformed plants with multiple MOA resistance against given insect pests.

Several methods can be used to perform competition experiments for the binding of at least one candidate ligand compared to at least one toxin. One example is binding assays with radio labeled candidate ligand or toxin similar to the method described in Iracheta et al. (2005) (Screening for *Bacillus thuringiensis* Crystal Proteins Active against the Cabbage Looper, *Trichoplusia ni*, J. INVERTEBR. PATHOL., 76, 70-75) and Jimenez-Juarez et al. (2007) (*Bacillus thuringiensis* Cry1Ab Mutants Affecting Oligomer Formation Are Non-toxic to *Manduca sexta* Larvae, J. BIOL. CHEM. 282 (28), 21222-21229).

It should be understood that the entire disclosure of each reference cited herein is incorporated within the disclosure of this application.

The following examples are included to demonstrate aspects of the invention. Those of skill in the art should, in light of the present disclosure, appreciate that many changes can be made in the specific aspects which are disclosed and still obtain like or similar results without departing from the spirit and scope of the disclosure.

Example 1. Identify Insect Receptors for Bt Toxin by Yeast Two Hybrid Method

A yeast two-hybrid was performed to identify receptors for Cry3Bb toxin. The coding sequence for the Cry toxin was PCR-amplified and cloned into pB27 as a C-terminal fusion to LexA (N-LexA-Cry toxin-C). A cDNA library was created for midgut tissue collected from *Diabrotica virgifera virgifera* for use as prey in the assay. For interaction analysis, the ULTImate screen was performed by Hybrigenics (Paris, France). Results of this screen identified ABC transporter (SEQ ID NO: 21) as receptor for Cry3Bb toxins.

Furthermore, yeast two-hybrid was also performed to identify fragments of either ABC transporter or Aminopeptidase that are sufficient to bind Bt toxins.

TABLE 2

| Fragment | 5' terminal nucleotide | 3' terminal nucleotide |
|---|---|---|
| 1 | 1166 | 1857 |
| 2 | 1166 | 1860 |
| 3 | 1166 | 1817 |
| 4 | 1166 | 1831 |
| 5 | 1196 | 1887 |
| 6 | 1196 | 1899 |
| 7 | 1263 | 1970 |
| 8 | 1383 | 1976 |
| 9 | 1461 | 2078 |
| 10 | 1461 | 2115 |
| 11 | 1130 | 1862 |
| 12 | 1128 | 1862 |
| 13 | 1242 | 1862 |
| 14 | 1127 | 1862 |
| 15 | 1321 | 1952 |
| 16 | 1311 | 1952 |
| 17 | 1487 | 2153 |

TABLE 2-continued

| Fragment | 5' terminal nucleotide | 3' terminal nucleotide |
|---|---|---|
| 18 | 1383 | 1967 |
| 19 | 1481 | 2115 |
| 20 | 1494 | 2115 |

Interaction of ABC transporter fragments with Cry3Bb was demonstrated by yeast two-hybrid experiments. The 5' and 3' terminal nucleotides in Table 2 representing the start and end points of ABC transporter fragments are corresponding to the nucleotide position in the full length *Diabrotica virgifera virgifera* ABC transporter. Fragments 1-20 of ABC transporter were demonstrated to have positive interaction with Cry3Bb.

TABLE 3

| Aminopeptidase Fragment | amino terminal amino acid | carboxy terminal amino acid | Interaction with Cry3Aa |
|---|---|---|---|
| 1 | 16 | 916 | negative |
| 2 | 16 | 174 | positive |
| 3 | 16 | 249 | positive |
| 4 | 249 | 528 | positive |
| 5 | 505 | 916 | negative |
| 6 | 249 | 916 | negative |
| 7 | 16 | 470 | positive |
| 8 | 16 | 470 | positive |
| 9 | 16 | 528 | positive |

Interaction of Aminopeptidase N (as set forth in SEQ ID NO: 22) fragments with Cry3Aa, TIC1201 or Cry3Bb was characterized by yeast two-hybrid experiments as shown in Table 3. Results with Cry3Bb and TIC1201 were all negative.

Example 2. Isolate Bt Receptor Genes

This example illustrates the isolation of Bt receptor genes from various insects exhibiting susceptibility to a particular Bt toxin.

All insects for these studies were obtained from the Monsanto insectory. RNA was isolated using the RNeasy Kit for high Lipid containing tissues (Qiagen, Valencia, Calif.). cDNA was transcribed using oligodT primers and Superscript III reverse transcriptase according to manufacturers' recommendations (Life Technologies, Carlsbad, Calif.). The gene information for ALP1, APN1, and APN6 from *Trichoplusia ni* was obtained from NCBI locus identifiers AEG79734, AAX39863, and AAX39863 respectively. Primers were designed based on this sequence for isolation of the full length transcript. For *Helicoverpa zea* ALP1, ALP2, and APN1, the sequences in the public database for *Helicoverpa armigera* were used to design primers for isolation of the full length transcript. The sequences for these genes were obtained from the following NCBI locus identifiers: ALP1 from ACF40806, ALP2 from ACF40807, APN1 from AAQ57405 and related sequences. Both ALP1 and ALP2 were cloned with primers designed to these sequences. However, APN1 from *Helicoverpa armigera* was sufficiently different at the C-terminus and thus 3'RACE was used to determine the full coding region by extension of the transcript using GeneRACER technology (Life Technologies, Carlsbad, Calif.). Another amplicon from the *Helicoverpa zea* 3'RACE reaction was APN3. This gene was also cloned and included in the analysis. Partial sequence for *Pseudoplusia includens* Aminopeptidase N1 was obtained from Monsanto proprietary databases. The complete sequence was not available and therefore 5' and 3' Rapid Amplification of cDNA Ends (RACE) was performed to isolate and confirm the complete coding region of this gene. RACE was performed according to the GeneRacer kit (Life Technologies, San Diego, Calif.). Partial sequence for *Diabrotica virgifera virgifera* ADAM metalloprotease and ABC transporter was obtained from Monsanto proprietary databases. RACE was performed to identify the 5' and 3' coding sequences for ADAM and ABC transporter. Two variants for ADAM were identified where one possessed a predicted transmembrane domain (Pfam) with a C-terminal extension and the other contained only the predicted extracellular, N-terminal portion of the gene.

Based on the analysis of the amino acid sequence of SfALP1, the encoded sequence has an N-terminal secretion signal and a C-terminal GPI-anchor and transmembrane sequence, and one predicted N-linked glycosylation site (Asn-261). SfALP1 is therefore a type-Ia transmembrane protein with the bulk of the structure lying on the extracellular side of the plasma membrane, and tethered at the C-terminus with a GPI-anchor.

Example 3. Engineering Cadherin (CAD) TBR2 and TBR3 Variants

This example illustrates the engineering of cadherin proteins to which a target Bt toxin does not bind.

The sequence for Cadherin from *Trichoplusia ni* (hereafter referred to as TnCAD) was obtained from NCBI locus identifier AEA29692. Primers were designed based on this sequence for isolation of the full length transcript. The first 1800 bp were amplified along with a second amplification of the region from 1800 bp to the end of the gene to clone the full length coding sequence for TnCAD. Overlapping PCR was used to extend the gene and clone it into a TOPO vector. Two versions of TnCAD were obtained.

The gene information for *Pseudoplusia includens* Cadherin (hereafter referred to as PiCAD) was obtained, in part, from a Monsanto proprietary sequence collection for this organism by performing BLAST searches using the TnCAD sequence. Primers were designed to amplify and confirm 5' and 3' ends of the transcript for PiCAD using RACE.

To clone the full length version of PiCAD, three regions of PiCAD were individually amplified and combined using overlapping PCR to obtain the complete coding region. The three regions that were used were the 5'RACE amplicon from start to 500 bp, the region from 450 bp to 1300 bp, and the region from 1000 bp to the end of the transcript. The final assembled sequence resulted in two versions of PiCAD.

Figure 1:
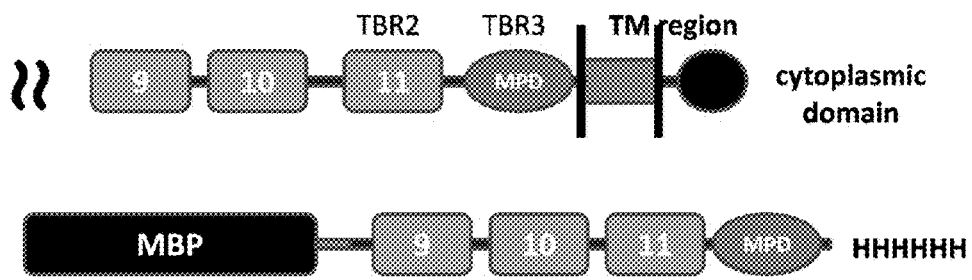
FIG. 1 illustrates that 1A. the partial protein structure of Cadherin receptor including the Toxin binding region (TBR)2 and TBR3; The present invention designed the constructs to express receptor fragments based on the partial structure. 1B. and 1C. the alignment of Cadherin receptors from CBW=Cotton Bollworm; TBW=Tobacco Budworm; THW=Tobacco Hornworm; SW=Silkworm; FAW=Fall Armyworm; BAW=Beet Armyworm; CBL=Cabbage Looper; SBL=Soybean Looper; and the mutations in TBR2 and 3 respectively for TnCAD fragment made by the present invention.
Figure 1:
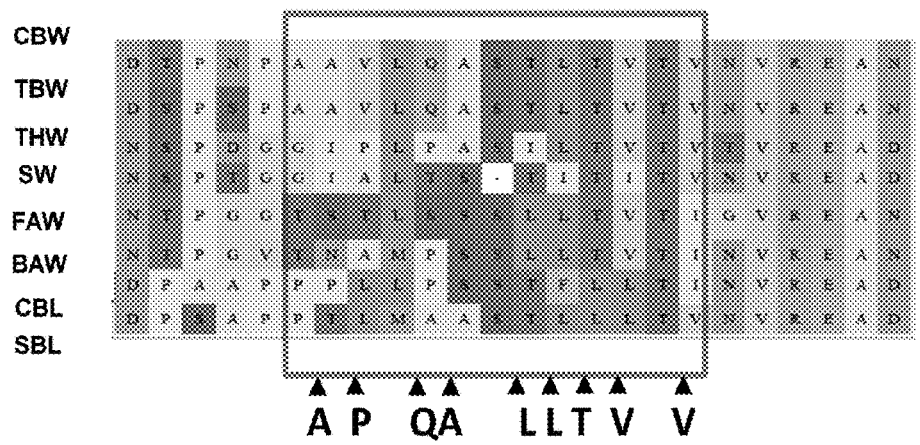
Figure 1:
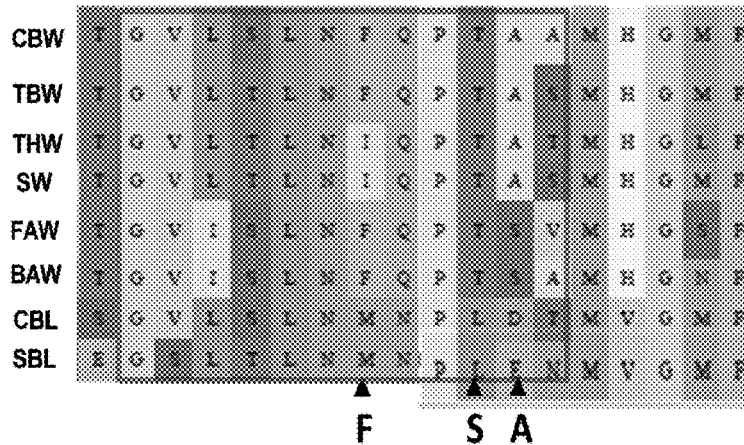

Two regions, i.e. TBR2 and TBR3, were suggested being important for toxin-receptor interaction by Gómez et al. (2003) BIOCHEMISTRY 42(35):10482-9, Xie et al. (2005) J BIOL CHEM. 280(9):8416-25, and Chen et al. (2007) PROC NAT'L ACAD SCI. 104(35):13901-6. However, the cloned TnCAD and PiCAD sequences of the present invention are quite different compared to those from the other Lepidopteran insects. Based on the sequence alignment provided herein in FIGS. 1B and C, TBR3 modifications (as shown in FIG. 6C) were cloned into PiCAD. TBR3 (as shown in FIG. 1C) and TBR2 modifications (FIG. 1B) were cloned into TnCAD.

Example 4. Protein Expression

The receptor genes in the current disclosure were cloned into baculovirus expression system (Gibco BRL Catalogue No. 10359-016) according to the manufacturer's provided protocols. Sequences were verified using standard Sanger sequencing methods. Baculovirus stocks were created using Bac-to-Bac (Invitrogen) and BacMagic-3 kits from Life technologies and Novagen, respectively.

Example 5. Demonstrate Binding of Bt Toxin and its Receptor

Ligand Blot Analysis

This example illustrates the binding of Cry toxin proteins to certain Tn or Pi CAD proteins or to modified Tn or Pi CAD proteins. Constructs expressing TnCAD TBR3 variant and TBR2 variant were generated to determine if the amino acid changes illustrated in FIGS. 1B and C result in increased Cry1A-type toxin binding.

Ligand blotting of receptors with toxins is known in the art and was used for demonstrating the specific binding of Cry toxins to binding proteins/receptors. For non-limiting examples see: Xie, R., et al. (2005) J. BIOL. CHEM. 280: 8416-8425; Griko, N. B., et al. (2007) BIOCHEMISTRY 46:10001-10007.

Analysis of these two receptor polypeptides by ligand blot demonstrate that Cry1Ac (FIG. 2B) and Cry1Ab (FIG. 2A) tryptic cores bound to both the MBP-fusion protein and the TVMV protease cleaved TnCAD TBR3 variant, whereas the wild type TnCAD protein did not bind to either toxin. The tryptic cores of Cry proteins were produced by digesting the full-length Cry protein with trypsin. Mutations in TnCAD TBR2 that had been previously implicated in Cry1A toxin binding (Gomez et al. (2003) BIOCHEMISTRY. 2003 Sep. 9; 42(35):10482-9) had no effect.

Pulldown Analysis

Pulldown analysis were also performed to determine if TnCAD TBR2 variant and TBR3 variant interact with Cry1Ab tryptic core. Purified TnCAD TBR2 or TBR3 was mixed with Cry1Ab or Cry1Ac. This mixture was then immobilized via C-terminal 6× Histidine tag of TnCAT TBR3 to NiNTA resin. The protein complex bound to the NiNTA resin was eluted and resolved by SDS-PAGE to determine if the bead-bound protein fraction contained Cry1Ab tryptic core. The results of the pull-down experiment indicate that TnCAD TBR3 interacts with the tryptic core of Cry1Ab (FIG. 3B) and that this region of Cadherin is involved in Cry1Ab toxin binding.

Gel-Filtration

Another method to determine TnCAD TBR3 variant interaction with the tryptic core of Cry1Ab is gel filtration. Purified TnCAD TBR3 variant was mixed with Cry1Ab tryptic core and purified through a HiLoad16/60 Superdex200 gel filtration column. The peak fractions from gel filtration were resolved by SDS-PAGE to check the purity and confirm the interaction between TnCAD TBR3 variant and Cry1Ab. A distinct peak labeled as Cadherin-Cry1Ab_TC in FIG. 3A was seen for the complex of receptor and toxin core before each individual protein labeled as Cadherin or Cry1Ab_TC was detected (FIG. 3A).

Example 6. Determination of the Cadherin Ligand Binding Region

Figure 4:
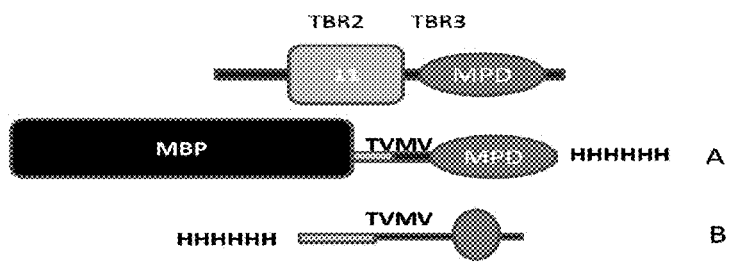
Figure 4:
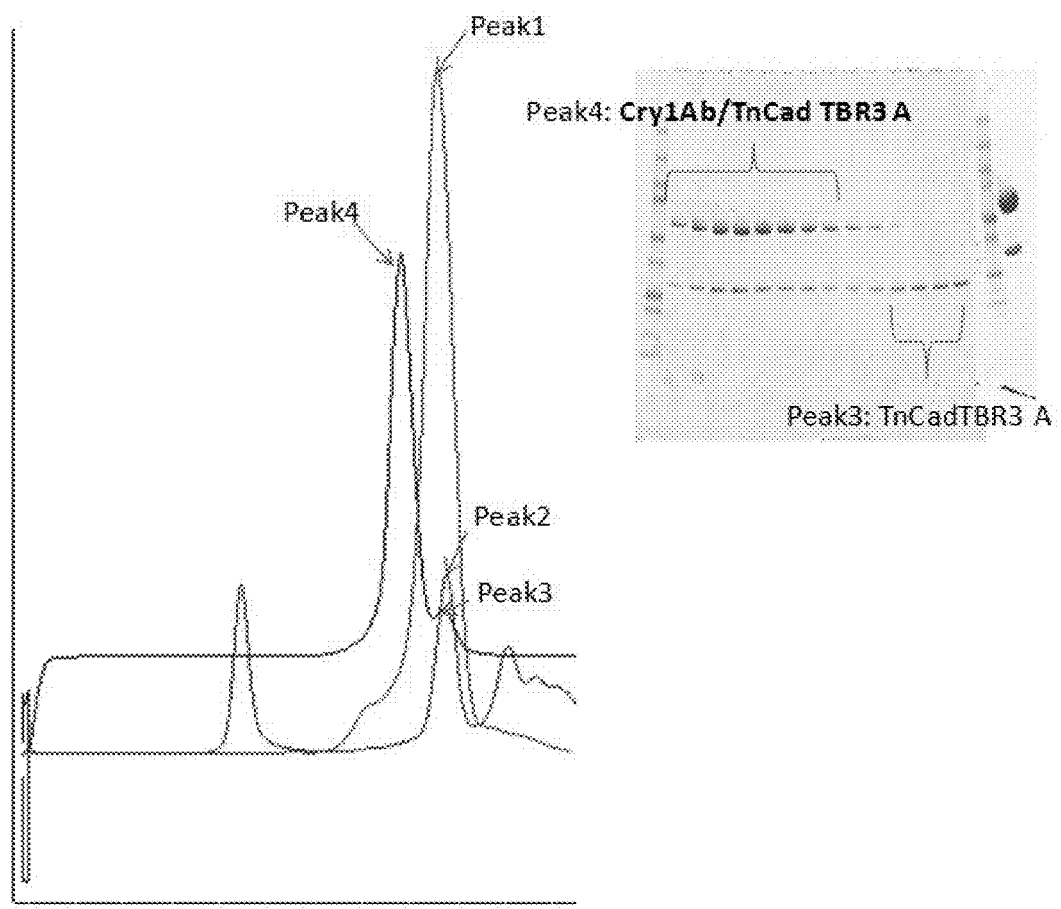
Figure 4:
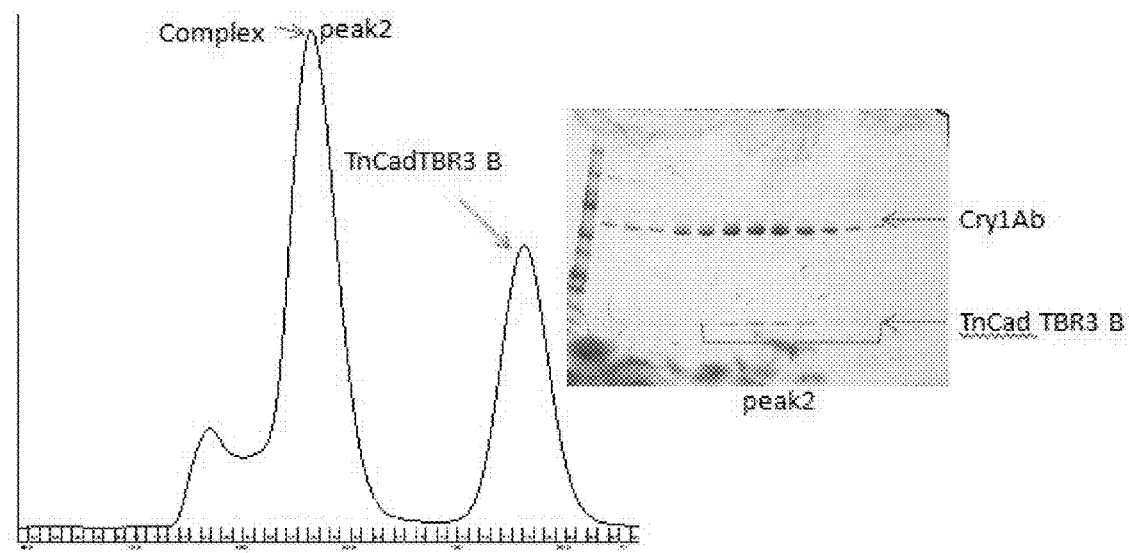

Two truncation variants of TnCAD TBR3 variant A (SEQ ID NO: 139), and B (SEQ ID NO: 140) (as shown in FIG. 4A) were designed to determine the toxin binding region of Cadherin. The constructs were made with cleavable MBP fusion at the N-terminus and/or with tag N6His at the C-terminus or at the N-terminus. These constructs were expressed in *E. coli*, subsequently purified by Ni-NTA, and were then mixed with Cry1Ab by molar ratio 1.2:1. This mixture was purified by a sizing column using either superdex75 or superdex200. Both proteins were confirmed to bind Cry1Ab tryptic core as shown in FIGS. 4 B and C.

Example 7. Assess Binding Affinity of a Candidate Ligand to its Receptor

Assessing Binding Affinity of TnCAD TBR3 Variant (SEQ ID NO: 6) and Toxin Candidates Surface plasmon resonance (SPR) experiments were performed using a Biacore T000 instrument. Sensorgrams were processed with Scrubber Version 2.0b, biologic Software (Campbell, Australia). To determine the affinity of the TnCAD protein to toxins containing Cry1A domains, the purified TnCAD and TBR3 variant TnCAD protein were immobilized on the Biacore chip. Toxins, including the tryptic cores (TC-) of TIC105, TIC107, and Cry1Ab were used as analytes and the affinity of each protein was determined towards TnCAD TBR3 variant. Binding was determined for TIC107 and Cry1Ab (FIG. 3C) with respective Kd values of 645 nM and 470 nM respectively. No binding was seen for TIC105 (FIG. 3C).

Assessing Binding Characteristics of Sf ALP (SEQ ID NO:16) and Toxin Candidates

SPR experiments were also performed for SfALP and tryptic cores (TC_) of Cry2Ab and Cry1Ca. Binding kinetic of TC-Cry2Ab to SfALP is biphasic, indicating heterogeneity or two-phase/conformation change as shown in FIG. 5A. Binding of TC_Cry1Ca is significant as shown in FIG. 5B. While TC_Cry2Ab and TC_Cry1Ca showed binding to ALP, TC_Cry1Ac and TC_Tic105 did not show interaction with ALP (FIG. 5C).

Example 8. Assessing Cytotoxicity of a Toxin

*S. frugiperda* (Sf9) cells obtained from ATCC (ATCC-CRL 1711) are grown at 27° C. in Sf-900 II serum free medium (Gibco BRL, Catalogue No. 10902-088). These cells, which are not susceptible to some Bt toxins, are transfected with an expression construct for a Bt toxin receptor disclosed herein. Then the transfected Sf9 cells expressing the Bt toxin receptor are exposed to one or more Bt toxins known to bind to the Bt toxin receptor and then stained using SYTOX Orange dye (used as an indicator of cell death) to detect compromised membranes. Bt toxins used in this study include, but not limited to, Cry2Ab (GenBank accession number: AAA22342), Cry1AC (GenBank accession number AA22331), TIC105 described in U.S. Pat. No. 8,034,997 and TIC107 described in U.S. Pat. No. 7,741,118, all of which are incorporated herein by reference.

Cytotoxicity Assessment of PiCAD TBR3 Variant (as Set Forth in SEQ ID NO: 10)

The sequence changes to the variant modified PiCAD TBR3 are illustrated in FIG. 5C. PiCAD TBR3 variant and its wild type control were expressed in Sf9 cells and the transfected Sf9 cells were exposed various Bt toxins to determine if expression of TBR3 variant in cell line Sf9 results in increased sensitivity to Cry1A-type toxins.

Cry1Ac and TIC107 (a Cry1A-type protein toxin) were used in binding assays to qualitatively assess binding characteristics with wild type PiCAD. No effect was seen for the wild type PiCAD control demonstrating that it is not sufficient in this context as a Cry1Ac or TIC107 receptor (FIG. 6A). However, expression of TBR3 variant resulted in increased sensitivity to Cry1Ac and TIC107 (FIG. 6B).

These results demonstrate that the modifications made by the present invention in the TBR3 region sequence are responsible for Bt toxin receptor binding and responsible for driving receptor oligomerization and pore formation of the toxin resulting in cell death.

Cytotoxicity Assessment of *Spodoptera frugiperda* ABC Transporter (as Set Forth in SEQ ID NO:15)

*Spodoptera frugiperda* ABC transporter was expressed by baculovirus mediated infection of SF9 insect cells. Briefly, 50,000 SF9 cells were seeded two days prior on poly-D lysine coated plates. After cell attachment, the cells were infected with a 1:50 dilution of a P3 viral stock for expression of ABC transporter. The cells were challenged with 50 ppm of Cry1Ac, TIC107 or buffer control (50 mM CAPS pH 10.8, 10 mM DTT) after 42 hours. A Safire 2 plate reader (488 excitation/530 emission) was used to record values on the cells after 2 hours. Representative images as shown in FIG. 7A were captured on an inverted microscope equipped with a GFP filter as well as a bright field image of the same area.

Table 4 shows a number of ABC transporters identified from the cytotoxicity assessment as Bt toxin receptors by the present application.

TABLE 4

| | PRT | | Sytox Green Fluresence | |
|---|---|---|---|---|
| receptor | SEQ ID NO | toxin | treatment | control buffer |
| HzABCa7 | 172 | Cry2AB | 55345 | 5398 |
| SfABCa3 | 177 | Cry2AB | 30648 | 5398 |
| SfABCc2 | 181 | Tic105 | 14928 | 645 |
| SfABCc2 | 181 | Cry1Ac | 20686 | 645 |
| SfABCc3 | 37 | Tic105 | 17667 | 645 |
| SfABCc3 | 37 | Cry1Ac | 18560 | 645 |
| HzABCc2 | 185 | Tic105 | 38780 | 1104 |
| SfABCc5 | 183 | Tic107 | 33024 | 5398 |

Example 9. Differentiate Toxin MOA Via dsRNA Suppression of Toxin Receptors

Double-stranded RNAs (dsRNA) as set forth in SEQ ID NO: 147 and 148 corresponding to Cry3Bb receptors/binding partners, e.g., WCR Cadherin (seq ID NO:55) and ADAM metalloprotease (SEQ ID NO: 20) respectively were fed to *Diabrotica virgifera virgifera* (also referred as Western Corn Rootworm) neonate larvae for 4 days to knockdown the candidate receptor gene. The larvae were then transferred to a new diet plate containing the toxin (2000 to 6000 ppm) for 6 days. The controls are buffer and dsRNA-only samples to assure dsRNA by itself does not cause insect mortality.

Larvae from each sample were measured for the percentage of an 8-insect population that exhibited mortality or 2nd/3rd-instar stunting on the tenth day. This percentage is also termed percent effective control (% EC). Replicates of 8-insect populations were averaged for a mean % EC (±SE on the mean).

Decreased Cry3Bb toxicity indicates that the candidate gene encodes a protein involved in Cry3Bb toxicity. This protein can be a receptor, a binding partner or a protein involved in secondary events to the initial binding interaction. In addition, larval samples at day 4 and day 11 were submitted to RNA extraction and real-time PCR to verify gene transcript knock-down.

The results showed that the dsRNA targeting Cadherin or ADAM metalloprotease conferred Cry3Bb resistance (FIG. 8), and the combined dsRNA targeting both Cadherin and ADAM metalloprotease simultaneously conferred synergistic Cry3Bb resistance. None of these dsRNA molecules had any statistically significant effect on TIC1201 toxicity in Western Corn Rootworm. These results demonstrated that cadherin and ADAM metalloprotese are essential for Cry3Bb toxicity, but not for TIC1201 toxicity, indicating the differences in MOA by Cry3Bb and TIC1201. Therefore combining or stacking Cry3Bb and TIC1201 will be effective in reducing the risk of resistance when mutations in Cadherin or ADAM metalloprotease are potential underlying mechanisms (Morin, Shai et al. Proc Natl Acad Sci USA. 2003 Apr. 29; 100(9): 5004-5009).

Example 10. Identify Bt Toxin Receptors from *Diabrotica virgifera virgifera* cDNA libraries were generated from mid-guts of *Diabrotica virgifera virgifera* (Western corn rootworm, WCR) third instar larvae reared on corn plants and sequenced by high-throughput sequencing using commercially available 454 technology (454 Life Sciences, 15 Commercial St., Branford, Conn. 06405, USA), as described in Margulies et al. (2005) NATURE, 437:376-380. This provided approximately 1.27 million ~300 base-pair reads, which were supplemented with 17,800 publicly available ~520 base-pair Sanger reads from NCBI. The combined sequence data were assembled into contigs de novo using the Newbler (version 2.3) software package (454 Life Sciences, 15 Commercial St., Branford, Conn. 06405, USA). Approximately 16,130 genes were identified from the assembled sequence data.

For sequence annotation, Blast based annotation was performed by using NCBI's Blastall 2.2.21 software to search *Diabrotica virgifera virgifera* contigs against the publicly available uniref90.fasta database (ftp.uniprotorg/pub/databases/uniprot/current_release/uniref/uniref90/).

The blast search was performed in blastx mode (translated *Diabrotica virgifera virgifera* nucleotide queries searched against the uniref90 protein database). Only blast hits with an e-value less than or equal to 9e-9 were retained. For each *Diabrotica virgifera virgifera* contig the description line from the uniref90 best hit was used as an annotation. When no Blast hits were found, the sequence was subjected to a supplementary Pfam search. To accomplish this, the longest open reading frame (ORF) was identified for each *Diabrotica virgifera virgifera* contig and used to query the publicly available Pfam-A database (ftp.sanger.ac.uk/pub/databases/Pfam/current_release) using the publicly available HMMER 3.0 software package (hmmer janelia.org/). *Diabrotica virgifera virgifera* contigs with a Pfam hit with an e-value less than or equal to 1e-5 were annotated with the protein family name and the Pfam identifier.

TABLE 5

Bt toxin receptors identified from *Diabrotica virgifera virgifera*

| Gene identifier | NUC SEQ ID NO | PEP SEQ ID NO | annotation |
| --- | --- | --- | --- |
| Diabrotica_virgifera_virgifera_ABC_transporter_105_10 | 45 | 92 | ABC transporter |
| Diabrotica_virgifera_virgifera_ABC_transporter_105_9 | 46 | 93 | ABC transporter |

TABLE 5-continued

Bt toxin receptors identified from *Diabrotica virgifera virgifera*

| Gene identifier | NUC SEQ ID NO | PEP SEQ ID NO | annotation |
| --- | --- | --- | --- |
| Diabrotica_virgifera_virgifera_ABC_transporter_218_1 | 47 | 94 | ABC transporter |
| Diabrotica_virgifera_virgifera_ABC_transporter_218_2 | 48 | 95 | ABC transporter |
| Diabrotica_virgifera_virgifera_ABC_transporter_218_3 | 49 | 96 | ABC transporter |
| Diabrotica_virgifera_virgifera_ABC_transporter_218_4 | 50 | 97 | ABC transporter |
| Diabrotica_virgifera_virgifera_Aminopeptidase_837_1 | 51 | 98 | Aminopeptidase |
| Diabrotica_virgifera_virgifera_Aminopeptidase_837_2 | 52 | 99 | Aminopeptidase |
| Diabrotica_virgifera_virgifera_Aminopeptidase_871_1 | 53 | 100 | Aminopeptidase |
| Diabrotica_virgifera_virgifera_cadherin_1083_1 | 54 | 101 | cadherin like protein |
| Diabrotica_virgifera_virgifera_cadherin_1817_1 | 55 | 102 | cadherin like protein |
| Diabrotica_virgifera_virgifera_ABC_transporter_01859_1 | 56 | 103 | ABC transporter |
| Diabrotica_virgifera_virgifera_ABC_transporter_01867_1 | 57 | 104 | ABC transporter |
| Diabrotica_virgifera_virgifera_ABC_transporter_01873_1 | 58 | 105 | ABC transporter |
| Diabrotica_virgifera_virgifera_Aminopeptidase_01949_1 | 59 | 106 | Aminopeptidase |
| Diabrotica_virgifera_virgifera_ADAM_metalloprotease_01952_1 | 60 | 107 | ADAM metalloprotease |
| Diabrotica_virgifera_virgifera_Aminopeptidase_02024_1 | 61 | 108 | Aminopeptidase |
| Diabrotica_virgifera_virgifera_Aminopeptidase_02031_1 | 62 | 109 | Aminopeptidase |
| Diabrotica_virgifera_virgifera_Aminopeptidase_02119_1 | 63 | 110 | Aminopeptidase |
| Diabrotica_virgifera_virgifera_ADAM_metalloprotease_02122_1 | 64 | 111 | ADAM metalloprotease |
| Diabrotica_virgifera_virgifera_Aminopeptidase_02140_1 | 65 | 112 | Aminopeptidase |
| DIADiabrotica_virgifera_virgifera_Aminopeptidase_02340_1 | 66 | 113 | Aminopeptidase |
| Diabrotica_virgifera_virgifera_ABC_transporter_02470_1 | 67 | 114 | ABC transporter |
| Diabrotica_virgifera_virgifera_ABC_transporter_02630_1 | 68 | 115 | ABC transporter |
| Diabrotica_virgifera_virgifera_ALP_02713_1 | 69 | 116 | Alkaline phosphatase |
| Diabrotica_virgifera_virgifera_Aminopeptidase_03898_1 | 70 | 117 | Aminopeptidase |
| Diabrotica_virgifera_virgifera_ADAM_metalloprotease_04620_1 | 71 | 118 | ADAM metalloprotease |
| Diabrotica_virgifera_virgifera_ADAM_metalloprotease_04627_1 | 72 | 119 | ADAM metalloprotease |
| Diabrotica_virgifera_virgifera_Aminopeptidase_04697_1 | 73 | 120 | Aminopeptidase |
| Diabrotica_virgifera_virgifera_Aminopeptidase_04881_1 | 74 | 121 | Aminopeptidase |
| Diabrotica_virgifera_virgifera_cadherin_04907_1 | 75 | 122 | cadherin |
| Diabrotica_virgifera_virgifera_Aminopeptidase_05042_1 | 76 | 123 | Aminopeptidase |
| Diabrotica_virgifera_virgifera_ADAM_metalloprotease_05390_1 | 77 | 124 | ADAM metalloprotease |
| Diabrotica_virgifera_virgifera_ABC_transporter_05581_1 | 78 | 125 | ABC transporter |
| Diabrotica_virgifera_virgifera_ADAM_metalloprotease_05844_1 | 79 | 126 | ADAM metalloprotease |
| Diabrotica_virgifera_virgifera_ABC_transporter_06637_1 | 80 | 127 | ABC transporter |
| Diabrotica_virgifera_virgifera_ADAM_metalloprotease_07383_1 | 81 | 128 | ADAM metalloprotease |
| Diabrotica_virgifera_virgifera_ABC_transporter_07661_1 | 82 | 129 | ABC transporter |

TABLE 5-continued

Bt toxin receptors identified from *Diabrotica virgifera virgifera*

| Gene identifier | NUC SEQ ID NO | PEP SEQ ID NO | annotation |
|---|---|---|---|
| *Diabrotica_virgifera_virgifera_*ADAM_metalloprotease_08650_1 | 83 | 130 | ADAM metalloprotease |
| *Diabrotica_virgifera_virgifera_*Aminopeptidase_08778_1 | 84 | 131 | Aminopeptidase |
| *Diabrotica_virgifera_virgifera_*Aminopeptidase_08810_1 | 85 | 132 | Aminopeptidase |
| *Diabrotica_virgifera_virgifera_*Aminopeptidase_09768_1 | 86 | 133 | Aminopeptidase |
| *Diabrotica_virgifera_virgifera_*cadherin_10167_1 | 87 | 134 | cadherin like protein |
| *Diabrotica_virgifera_virgifera_*ADAM_metalloprotease_10594_1 | 88 | 135 | ADAM metalloprotease |
| *Diabrotica_virgifera_virgifera_*ABC_transporter_11225_12 | 89 | 136 | ABC transporter |
| *Diabrotica_virgifera_virgifera_*ABC_transporter_11255_1 | 90 | 137 | ABC transporter |

Example 11. Microarray Methods

Nucleic acid molecules of the present invention can be used to monitor expression of target sequences. A microarray-based method for high-throughput monitoring of gene expression may be utilized to measure gene-specific hybridization targets. This 'chip'-based approach involves using microarrays of nucleic acid molecules as gene-specific hybridization targets to quantitatively measure expression of the corresponding genes (Schena et al., SCIENCE 270:467-470 (1995). Every nucleotide in a large sequence can be queried at the same time. Hybridization can be used to efficiently analyze nucleotide sequences. Several microarray methods have been described in the literature. One method compares the sequences to be analyzed by hybridization to a set of oligonucleotides or cDNA molecules representing all possible subsequences (Bains and Smith, J. THEOR. BIOL. 135: 303 (1989)). A second method hybridizes the sample to an array of oligonucleotide or cDNA probes. An array consisting of oligonucleotides or cDNA molecules complementary to subsequences of a target sequence can be used to determine the identity of a target sequence, measure its amount, and detect differences between the target and a reference sequence. Nucleic acid molecule microarrays may also be screened with protein molecules or fragments thereof to identify nucleic acid molecules that specifically bind protein molecules or fragments thereof. The microarray approach may also be used with polypeptide targets of the current invention. Essentially, polypeptides are synthesized on a substrate (microarray) and these polypeptides can be screened either with protein molecules or fragments thereof or nucleic acid molecules in order to screen for protein molecules or fragments thereof or for nucleic acid molecules

SEQUENCE LISTING (186 sequences)

SEQ ID NO: 1 - DNA, 1698 bp, Trichoplusia ni
atgaggtcgatagttacgttgctggtgttggtggctgcttgcggcgcgctcgccgaccgctaccaccccgctgagcccgctgagcgcgccgggccggccggccgcgcctcgcccgccgagctgctcggcagccactggcgggcgcaggcgcaggacgcgctcaaggagcgcctggcgcgccccgccaaccgcaacaaggcccgcaacgtcatcatgttcctgggcgacggcatgtccgtgcccacgctggccgctgcgcgtgcgctgctcggacagcgacagggcgccaccggcgaagaagcacagatgacttttgaaagtttccccacttccggtttaagtaagacgtattgcgtgaactctcaagttgcggactcagcgtgctccgcgacggcgtatttgtgcggcgtcaaaacaaatcaaggcttactcggagtggacgcgagcgtgcagcgacacaactgcgagtcatccatcgacaccgcccgccacgtggagtctatcgcggagtgggcgctcgccgacggcagagatgctggtattgtgacaacaacccgcattactcacgcgtctccagccggcgtgttcgccaagacggcgaaccgcaactgggagaacgacgcagaagtaaaagcggcgaaccaagacatcaacgcctgccccgacatagcttaccaactaatacacaaacatcccggcaacaagttcaaggttattttgggtggtggcaggcgcaacttcttgccaaccacagtgacagatgaagaatcgcaagccggcagaaggactgatggtcgaaatttaattgaagagtggcaacaggacaaagctgcccgtggtgtctcttttaagtacgtttggaacgtcagtgagcttctgcaactgaatgataatctgccagaatatttattaggattgtttgaaagcaaccatttgcagtatcacatgcaagcgaatctcaacactgagcccacacttgagcaactcacggaaactgcaatccgcatgctgaaccgaaatgagaagggtttctttttattcgtcgagggcggtcgcattgaccacgcccatcacgacaaccttgcgcacttagctcttgacgaaactcttgaaatggataaagctatcaagcgcgccgttgatctgctctcggaggaagatactctaatcgtagtaacagccgaccacgcccacgttatgtcgtacaacgggtactctcgacgaggtaatagcattcttggaccctcaagagacactgacgaaaataatgtgccgtacatgacgctatcgtacaccaatgggcctggtttccgtccacatgtcaatggaaagcgatccgatgttacccaagagaacggatttggcactttgacgtggaaatcgcatgtcgacgtacccctagactcggaaacacacggcggtgatgacgtggcagtgttcgcgcgcggtccttaccatatgcttttcacggggctgtacgagcagaatcagataccccaccttatggcctacgccgcctgcatcggtcccggcctgcactcgtgtgccgaggccgacaccacctccacgccagaggcgaacccttcagaggctactaccgccagcccaacgaccgctgaaccatcagctgcggcgcctgtcagcgctacgctcgcactttttgctctactcactactcttactttgttattacactaa

SEQ ID NO: 2 - DNA, 2949 bp, Trichoplusia ni
atggcaaatcgcttcacattgctccttttgggggtggccctggcccagggcatccttgcctatagtcccatcgagatgccagaggacgaatggcaggaatacaggaatttaatgagggatcctacgtatagactagtacgaacaaccgaacctgaaacttataaagtgactctgacgccatactttgatactaatgacgcgaaagctttcactttcgatggagaagtggagattctcataaaggccaatcaagctgtttcagagatcgtgctacactgcaacgatttgactatttcaaaattgactgttactacggagacctccacaactgatttggccgaagccggtcaaaccttcacttgcgaagcaaatactagctttttaagaataaaaactacgtcacctttggaggctgaagctaaatacgtcataaagagcgaatttacgggtaatctccaaactaacatgagaggtttttacagaagttggtatgtcgacagcagtggtaataagagatggatggctacaactcaattccaacctggtcatgcgcgccaggccttcccttgctacgatgaaccgtctttcaaggccttattcgatattaccatcaagcggctaccggacttctctgaaaccctatcaaacatgccaatcaaaacaaggggaccgctcactgatggtagaattgctgaaaccttccacactactcctaaaacctctacgtatttgcttgcgttcattgtttctcactacaaggaggttgctactggcaccgacctcaatagaccctttaagatctatgctcgtgacaatgctaaactcaccggagattggtctttggatattggtgaacgtcttctcgaagagatggagaagatcacagatgttccatactacggaatggctctaaacatggatatgaaacaggccgccatccctgacttttctgcaggagctatggaaaattggggtcttttgacatacagagaagccctcattctttacgatcctaaacattccaaccatttctacaagcaacgtgtagccaacattgtgtctcatgagattgctcacatgtggttcggaaattacgtcacttgcgcctggtgggacaacctgtggctaaacgaaggattcgcgagattctaccaatactacttgacagacagggttgataaaaatttaggctttgatactcgtttcatcgtggagcaactgcacacgtcactgctttccgactctggtgttaacgctcatcccttgacagacgagaatgtgagcagcccaacaactgtcagcgctcatttctcaaccatcacctacgccaaaggagcctctgtactcagaatgacgcagcacttgctcggtaactcaacttttgagaaaggtcttaggagctatctgaaagcaaggagatatgatgtcgccacacctgatgacttgttcgacgcacttcaagaagctgcaacattggatggagccctgacccagtatcctggtgccactgttaaggcctattttgaaacttggacatcaaaagctggtcacccgctactgacagttactgttggtaacgatggaactatgaaagtaactcaggaacgctttggactcactcctgtcactacttttgaaggaacttggcaaattccaataacttggactagtcaaggaaatgtggacttttatgatcttaagccatcccgtattttaactggaacttctacaactatcgatgttggcactgatcaaagaggttggcttattttcaacaaacagcaaactggtttctacagggttgactacgatccaattacttgggcacataacaccatggctctaaggaacgctgaagtaaggaaggacatccatgtatacaaccgtgcccagatcgtggatgacgtatttttactagccagatctgaaaggatgacctacagacaggcgtttaacattctctcgttccttgaatttgaagacgagtacgcaccttggatcgccgctattgccggatttaactttgctgtgaggagattggctcacgatgaagctgctttagccaagttacaggcacatatccacagcactgccgctgctgttgtcaatcgtttaggttacgaagacaagggtggagacgataactttatggacgacctcctccgcatgaacctcatgcagttcctctgcaacgtcaatcacgaaaagtgtatagaggaaggagtcaaatccttccagagctggaaagcgaatgaagcattccacatccccgctaaccaccgtccatgggtctactgcgctggtctccgggctggtgacgctagcgatttcgatgtcttctggtcacgttacctcaaagaagatctggctagtgagaaggtagtcatggttactgcagccggttgtactggagacgaggcaagcttacgcaagttcctgaatgccattgtggatgacaaggaagacattagacctcaagactattctgttgccctcaactctgccattgcttcaaacgaagttaatacactgagagccttcgaatggttgaaaactaacgtggaccaaactgtgaagacgcttggcagtatcaactctcctctcagcacaattagcagtcgactgttgaatgacgctcagattaatactgtcgaaacctggttgaatgaaaacgctgaaattatcggtgcatcagctgtagccgctggcagatctggtattgcgacttctaagagcaatatcgagtggttgactaagaggaaggttgaattcgaagattacttcgaaaccgggttcgaagatcccttggccccaccagtaaccgaaactgaagcctcgaccagcagcccgacagctgctccgtccaccaccgaggctcctgcctcagcaagcactgccgcacttagtgtcgtcgccatgttggtcacccttgctgtcaacatggtctaa

SEQ ID NO: 3 - DNA, 2880 bp, Trichoplusia ni
atgtcccaaacattgctatgggccctgggcttagcgctcctggcggttgccaaggccgacaaccctatatcttattatatagaatcccaggatttcccatttgatgaaataccagaagatacgatctccagaaatgatcaacgagtgtacagactcccaacgtctgtggttcccgtagaatatgatattcatataaatctattctttgctgagaggactgaaaaaccattcagctatgaaggatttgagaccatcattgttgaggcaaaggaagaagtcaatgaaatcgtccttcatgctaatgtggacagaattcagtcaatctcggtgtttgactccacgggcagacctctcagactacagcgatttaatccattccatacggagaaagtctaccactttctgaagatcaatctcgctgagactttggcagttggcgcgaaatacactcttcacattaattatgaaggtaccatgaacgtagggcctatgaagcgaggtatttggaggggatggtacgtcgacagtaacaatgttgaaaggatttacgccaccactcacttccagccttataatgccaggcaggcattcccatgctgggatgagccttatttcaaggcaattttcaaactacaccttagtagtccatcaggatatactggaacattctcaaacactgccatcgaacaaacagtttctttacccaacaaccgagtaagagtggactttgcgcctacacccaaaatgtcttcttacctcgtcactttcttagtcagcgagagcttccaagtcattgctcaggacacctccttcgatcctccgatcaggatcatcggcagatctaacacgaacggtctcgcagaccacgccttggacctggctgttaaaatgaccaagtactttgattcttacttcgaaatcccttattcatctctaagccctaatttattgaatgatcacatctcatctcctgattgggcttcagctggtactgaaaactggggaatggtcagttacagagagctctacctgatcttaagtgaagaagagacacttatgtctgttgagcactacgctgctactctggtatcccacgagctcgcacacaaatggttcggcaacttgatcacttgccactggtggagtaacacctggatcaacgaaggatatgccagctacttcggatacattgcaactcatgagatgttccctaaatacgagtttcctgaccacttcaacacccgatacctccagacttctctgtccttcgactctggtgtcagcactgttcctttgaaccacgacgtcaacactcctgctcaggtcaccggtcacttcggaactatcagttactcgaaagccgcagcctttttgagaatgactgctaatattatgtccccagagacctttaggaagtcttgcaaattgttcttgcaaagcaatgcctactcacctactgatccagatgatctattgaaatctatgctcgaagccattgaagaagacaactctttagctgactacggaagcttcagctttgctgactactacaacatctgggttaacgagcccggatacccaattctaaatgttactgttaaccacactaccggagtgatctccttgtctcaggaacgatttttcctaagttcgtctgctgcacctactggtcaaatctatccaattcctattactttctcaacaaaaacaaaccccagcttttcaatcctgaagccttctcatataatgacgggagcgactctcaccataaacaaagcggctgtcgaagaatgggtgatatttaataatatgcagcacggtcactacagagttaactatgattcgaaaacctggtctctgattgcggaagctttgttagaggaaccctcaccaatccatattttgaacagggctcagatcgtggacgatgtctttgccctaatgagatcgaacaggatgacacacaatgacggcttcaaaattttgaagttcttagccaaggagaccagtatacacatttggagccctgctattagtgggtttacctggctaaggaataggctgcgacacctaccggcaaaacaagctgaatttgatgcatttcttctcagtcaaatggaacatgcaatcaacgaattaggttatgagccaaagcccaatgagacgcctacaattacgatggctcgtcaagacatcctacagttcgcttgcactctcggccatgaaaagtgcaaccaggattcttgggagagattcgttaacctgcgagataacggggttccgatcaacgctcgtatccgtcgtaacgtctacatgacagctatgaggaaaggaaaccaacgcgacttcgagtatttactgaaccgcttcagatcgtccaactatgctaacgaccaactggaaatgttgcgaggaatgggcgcttctactgaccctgagttattgaccagatatttggcattgacgttacaaaaagccgttaggacgcatgacaagctgaactcctttaactacgcccttcttggaaacaacgagaacgttaaaactgtcgtcatgttcgtcaagcacaacattgatcaaattagaacagcatacgttgaagattctccagcaaacccagtccatagcgccctatccaatatcgccgcgtacttagatgaggatggtctggacgattatgaacattggctccgtacaacacagtctggtataccgcagtttaattcagcaatttctggtatcaactctgctcgcaacaacatagcttggggcacagcgaacgctgacgtcatccttgctgctgcaagaggcagcgctgccgctgcagtagcttcaataacgctactgatctgtatggctctcctgtcgacttttgtttaa

SEQ ID NO: 4 - DNA, 5202 bp, Trichoplusia ni
atggaggctgacgtccgaatcacgacggcagcgctgttattattcgctgccagctttgtcaacgcacaaaatgatggattgcgatgtacgtacatgaaagaaatacccagaggagaaactcccgtttttgaaataaaggactttgatggagtaccatggaaccagcagcctcttataccactgccacagcgagaggaactgtgcatagaagatcctgcctttgcaggaaattccatcgtcatgacaatttttatggaggaagagatcgagggagaaatagctatagccaagttaaattataaaggcactgaaaccccgagcatcaggcaacccttcgcttcaggtagtttccacatgctcggtcctgtcattcgtcggattcctgaagatggcggcgactggcaccttgttatcactaataagcaggactacgaggctcccgacatgcagcgctactcgttcgacatctcggtgccgagtgaatcagccgtcctcatagtgatgctggacatcatcaacatcgacgacaacgctcccataatacacatgatcgaccgttgcgagatacccgagccgggcgagttaggccgcacgtcgtgtgtgtacacggtgacggacgcggacggtcgcctcagcacggagttcatgacgtatgagatcgagagcgaccgcgacgacgctgactacttcgagctggtcaacgaccacaccatcgaccctgacgacaagaccactcacatggtcctctacctacacaaagccctagacttcgagctcaatcctcttcatatattcagagtcacggctttggactcgaagcccaacacccacactgtgacaatgatggtgcaagtcctgaacgtggaccgtaggaacccgcgctggctggacatcttcgccgtgcagcagttcgatgagaagactgtgcagaggttccacatcagggccatagatggtgacacggggctcgacagagaaatctactataagctggaagcggacgaagaagatacattcttctccctggagccaatcgcgggagatcgcagcggcgccacattagttgttgacaagatagacagagacactctacagcgggaagtgttccagctgtccatagtagcgtataagtacggtatcgatgataaagaggggaagaaccccttcgagaccagagccaacatcgtgatcatcgtcaatgacgtcaacgatcaaaggcctctccctttcaagaatacctacacaatagaaatagacgaagagacgcccatgaccctcaatttagaagactttgggttccacgacatagatctcggtgaaaacgctcaatatgaagtgttcttggagagtgtataccctgaaggtgccgaggaagctttcatgatctccccgacgaggggataccaggaacaatcgttcatagtgtcgacgagaaaccaccaccttctggactatgaagtggaaaaatatcaaaacattcagctaaaggtaaaagcaatagacttgaacgatactcgtttaacgggtgaggcgttgttgaacattaacctccggaactggaacgacgagctcccgatcttcgagcacagcgcgcagacggtagactttgacgagaccgtcgggaaggacttccctgtggccatcgtcaaggctgacgacagagatatcggtgataaagtcgtacactcattactaggcaatgctgaagattatctgacaattgatccggacactggtgagatatccgtcgctcacgatgactacttcgacttccatcggcaaaatgagttctttgttcaggtccgcgccacggacacgctgatggagccctacaactcggtgaccgcgcagctcaccatcaggctgcggaacatcaacaacacgccgcccacgctgctactccctcgcggtagtcctgaagtggaagagaacgtgccgcaagacttcgtgataccggcagagatcgcggccacggaccccgacctcgacgcacaactcgagttcgaaatagactgggagagctcgtacgcgaccaagcagggaagaccagctcccgatgttgagttccataaatgcgtggaaataataaccatccccacggagacccgtcaccgcgtcatcgggcgcctggacgtgaggaccatcagagagggagtcaccatcgactacgaggagttcgagatcctgtacctcagcatcaaggtctatgacaggaacactgtggctggtgctatcgatcatgctgaatcgatcctggccattaacataatcgacatgaacgacaacccgccggtgtgggcggcgggacagctgcggcaggcgctgcgcgtgcgcgagggctcgcccgccggcgggatcatcggctcactgctcgccaccgacatcgacggcccgctctacaataaagtgcggtactccatacatcctaagccaggcaccaaagaaggcctagtagcgatcgatcccatattgggtcagctgacggtcctgggtgacggagagatagacgcagacgtgcccaagacctggaccctggagtacaccgtcatcgccagcgaccgctgtgtggaggacgacggcgtggcctgcaccggcacggaccccactgtctggaacaccgagggcgatttatctatcgacatcatagacacaaacaacaagaacccggagaccgcgagccccagcattaccgtgtgggtttgggagaacgcgacccatggggaccccgtagcacagctctccgccaccgaccttgacagagacgagttataccacacggtccgctaccagatcctgtactcggtgaacccgatgctgctggagctgttcgcggtgaaccaggactcgggcctcatcaccgtgcactacactaccgacacggtgctggacagagacggcgactatccggaacacaccatcttcctcaacctcttcgataacttctttttcgatggagacgggcaacgcaatatggcggagaagagagtgctcgtggttctgttagatgtgaacgacaacgcgcccgaactgccgctacctgaagaactgtcctggtctgtgtccgaagacgagagagaagaagtacgcgtactaccacatatctacgctccggacagagacgagccggacacggataactctagggtcggctacgcgattcttggccttaaagtgaccaacagagagatcgaagtcccggagctgttcaacatgattcagatagagaacaagacaggagagctcgagaccgctcgccatctgaaaggattctggggaacttatagtatacatatacaggcgtacgaccacggcatccctcagcagatatctgaggagacgtacaccctcaccatccgcccctacaactaccacgaaccggtgttcgtgttcccacaggctggcaacaccttccgcttgtccagggagcagtcgacagtgaacggcgtgttggtccgcgtggacgggcagagcttcccgcgcgtgtcggccaccgacggggacgggctgcacgccggcagcgtcagcttcagcgtcgtcggggctgccgctgaatacttctccatgcgtaacttcgaggacaacactggcgagctttacctgtcgcagcccttgcctctagaagacgatggatttgatatcaccatccgcggttctgacgcgggcacagagccgggctcgctgttctcggaggtgtccttcagactggtgttcgtgcccacgcacggggaccctgtcttcagcgtcagccagtatactgtcgcttttatagaaaaagaggctggtttactggaatcccatcaactgccgagagctgtggacccgaagaactacatgtgtgaggaaatgaacgagccttgtcatgagatatactacagtattatcgataacaacgaggagggttacttccaagtgggctcgaccacaaacgtgatctccctatcccgcgagttggagcgtgcctcgcaggccagtcacgtggtccgcgtggcggcctccaacactctgctggacccggccgcgccgccgccgctgctgccctcctccaccttcctgctcaccatcaatgtccgtgaggctgacccgcggccagtattcgagagagagatctacaccgccggcatctacgagacggatacatccaacagggaactactcactgttcatgcgacacataccgaaggcctagacataacgtacacgatggacctggacacgatggtggtggacccctcgctggagggcgtgagggagtccgccttcacgctgcacccgagcagcggcgtcctgtccctcaacatgaacccgctcgacaccatggtcggcatgttcgaattcgatgtcgtggccactgacaccagaggtgcagaagcccgtactgacgtgaagatctatctgatcacccatctcaacagagtctacttcttgttcaacaacacgctggatgtcgttgactccaacagagctttcatagcggacacgttctcgtcggtgttcagcctgacgtgcaacatcgacgcggtgctgcgcgcgccggacagcagcggcgccgcgcgcgacgaccgcaccgaggtgcgcgcgcacttcatacgggaccacgtgcccgccaccaccgaggaaatagagcagctccgtagtaacacaatactgctgagagcgattcaggaaaccctgttaactcgcgaactgcatctggaggactttgtgggtggctccagcccagagctgggcgtggacaacagcctcacgatatacgtgctgggcgcgctcgccgcgctgctgggcttcctgtgcgtgctgctactcatcaccttcatcgtcaggactagagcgctcaaccgtcgtctggaagccctatccatgactaaatacggctcagtggactccgggctgaaccgcgtgggtctggccgcgcccgggaccaacaagcacgccgtcgagggctccaaccccatctggaacgagaccatcaaagcgccggacttcgatgcgatcagcgacgtttctaacgactcggacctgatcggtatcgaggacctgccgcagttccgcaacgactacttccctcccgctgacgacagctccctgaggggcatcgtacttgataatcagaacaacgacacggtggcgactcacggcaacaacttcaagttcaacgctagccccttcagcccggagttcgggaacacgcccatccggagataa

SEQ ID NO: 5 - DNA, 5202 bp, Trichoplusia ni
atggaggctgacgtccgaatcacgacggcagcgctgttattattcgctgccagctttgtcaacgcacaaaatgatggattgcgatgtacgtacatgaaagaaatacccagaggagaaactcccgtttttgaaataaaggactttgatggagtaccatggaaccagcagcctcttataccactgccacagcgagaggaactgtgcatagaagatcctgcctttgcaggaaattccatcgtcatgacaatttttatggaggaagagatcgagggagaaatagctatagccaagttaaattataaaggcactgaaaccccgagcatcaggcaacccttcgcatcgggtagtttccacatgctcggtcctgtcattcgtcggattcctgaagatggcggcgactggcaccttgttatcactaataagcaggactacgaggctcccgacatgcagcgctactcgttcgacatctcggtgccgagtgaatcagccgtcctcatagtgatgctggacatcatcaacatcgacgacaacgctcccataatacacatgatcgaccgttgcgagatacccgagccgggcgagttaggccgcacgtcgtgtgtgtacacggtgacggacgcggacggtcgcctcagcacggagttcatgacgtatgagatcgagagcgaccgcgacgatgcggtctacttcgagctggtcaacgaccacacgctcgaccctgacgacaaaaccacccacatggtcctctacctacacaaagccctagacttcgagctcaatcctcttcatatattcagagtcacggctttggactcaaagcccaacacccacactgtgacaatgatggtgcaagtcctgaacgtggaccgtaggaacccgcgctggctggacatcttcgccgtgcagcagttcgatgagaagactgtgcagaggttccacatcagggccatagacggtgacacggggctcgacagagaaatctactataagctggaagcggacgaagaagatacattcttctccctggaaccaatcgcgggagatcgcagcggcgccacattagttgttgacaagatagacagagacactctacagcgggaagtgttccagctgtccatagtagcgtataagtacggtatcgatgataaagaggggaagaaccccttcgagaccagagccaacatcgtgatcatcgtcaatgacgtcaacgatcaaaggcctctccctttcaagaatacctacacaatagaaatagacgaagagacgcccatgaccctcaatttagaagactttgggttccacgacatagatctcggtgaaaacgctcaatatgaagtgttcttggagagtgtataccctgaaggtgccgaggaagctttcatgatctccccgacgaggggataccaggaacaatcgttcatagtgtcgacgagaaaccaccaccttctggattatgaagtggaaaaatatcaaaacattcagctaaaggtaagagcaatagacttgaacgacactcgtttaacgggcgaggcgttgttgaacattaacctccggaactggaacgacgagctcccgatcttcgagcacagcgcgcagacggtagactttgacgagactgtcggaaaggacttccctgtggccatcgtcaaggctgacgacagagatatcggtgataaagttgtacactcattgctaggcaatgctgaagattatctgaaaattgatccggacactggtgagatatctgtcgctcacgatgactacttcgacttccatcggcaaaatgagttctttgtccaggtccgcgccacggacacgctgatggagccctacaactcggtgaccgcgcagctcaccatcaggctgcggaacatcaacaacacgccgcccacgctgctactccctcgcggtagtcctgaagtggaagagaacgtgccgcaagacttcgtgataccggcggagatcgcggccacggaccccgacctcgacgcacaactcgagttcgaaatagattgggagagctcgtacgcgaccaagcagggaagaccagctcccgatgttgagttccataaatgcgtggaaataataaccatccccacggagacccgtcaccgcgtcatcgggcgcctcgacgtgaggaccatcagagagggagtcaccatcgactacgaggagttcgagatcctgtacctcagcatcaaggtctatgacaggaacactgtggctggtgctatcgatcatgctgaatcgatcctggccatcaacataatcgacatgaacgacaacccgccggtgtgggcggcgggacagctgcggcaggcgctgcgcgtgcgcgagggctcgcccgccggcgggatcatcggctcactgctcgccaccgacatcgacggcccgctctacaataaagtgcggtactccatacatcctaagccaggcaccaaagaaggcctagtagcgatcgatcccatattgggtcagctgacggtcctgggtgacggagagatagacgcagacgtgcccaagacctggaccctggagtacaccgtcatcgccagcgaccgctgtgtggaggacgacggcgtggcctgcaccggcacggaccccactgtctggaacaccgaaggcgatttatctatcgacatcatagacacaaacaacaagaacccggagaccgcgagccccagcattaccgtgtgggtttgggagaacgcgacccatggggaccccgtagcacagctctccgccaccgaccttgacagagacgagttataccacacggtccgctaccagatcctgtactcggtgaacccgatgctgctggagcttttcgcggtggaccaggactcgggcctcatcaccgtgcactacactaccgacacggtgctggacagagacggcgactatccggaacacaccatcttcctcaacctcttcgataacttctttttcgatggagacgggcaacgcaatatggcggagaagagagtgctcgtggttctgttagatgtgaacgacaacgctcccgaactgccgctgcctgaagaactatcctggtctgtgtccgaagacgagagagaagaagtacgcgtactaccacatatctacgctccggacagagacgagccggacacggataactctagggtcggctacgcgattcttggccttaaagtgaccaacagagagatcgaagtcccggagctgttcaacatgattcagatagagaacaagacaggagagctcgagaccgctcgccatctgaaaggattctggggaacttatagtatacatatacaggcgtacgaccacggcatccctcagcagatatctgaggagacgtacaccctcaccatccgcccctacaactaccacgaaccggtgttcgtgttcccacaggctggcaacaccttccgcttgtccagggagcagtcgacagtgaacggcgtgttggtccgcgtggacgggcagagcttcccgcgcgtgtcggccaccgacggggacgggctgcacgccggcagcgtcagcttcagcgtcgtcggggctgccgctgaatacttctccatgcgtaacttcgaggacaacactggcgagctttacctgtcgcagcccttgcctctagaagacgatggatttgatatcaccatccgcggttctgacgcgggcacagagccgggctcgctgttctcggaggtgtccttcagactggtgttcgtgcccacgcacggggaccctgtcttcagcgtcagccagtatactgtcgcttttatagaaaaagaggctggtttactggaatcccatcaactgccgagagctgtggacccgaagaactacatgtgtgaggaaatgaacgagccttgtcatgagatatactacagtattatcgataacaacgaggagggttacttccaagtgggctcgaccacaaacgtgatctccctatcccgcgagttggagcgtgcctcgcaggccagtcacgtggtccgcgtggcggcctccaacactctgctggacccggccgcgccgccgccgctgctgccctcctccaccttcctgctcaccatcaatgtccgtgaggctgacccgcggccagtattcgagagagagatctacaccgccggcatctacgagacggatacatccaacagggaactactcactgttcatgcgacacataccgaaggcctagacataacgtacacgatggacctggacacgatggtggtggacccctcgctggagggcgtgagggagtccgccttcacgctgcacccgagcagcggcgtcctgtccctcaacatgaacccgctcgacaccatggtcggcatgttcgaattcgatgtcgtggccactgacaccagaggtgcagaagcccgtactgacgtgaagatctatctgatcacccatctcaacagagtctacttcttgttcaacaacacgctggatgtcgttgactccaacagagctttcatagcggacacgttctcgtcggtgttcagcctgacgtgcaacatcgacgcggtgctgcgcgcgccggacagcagcggcgccgcgcgcgacgaccgcaccgaggtgcgcgcgcacttcatacgggaccacgtgcccgccaccaccgaggaaatagagcagctccgtagtaacacaatactgctgagagcgattcaggaaaccctgttaactcgcgaactgcatctggaggactttgtgggtggctccagcccagagctgggcgtggacaacagcctcacgatatacgtgctgggcgcgctcgccgcgctgctgggcttcctgtgcgtgctgctactcatcaccttcatcgtcaggactagagcgctcaaccgtcgtctggaagccctatccatgactaaatacggctcagtggactccgggctgaaccgcgtgggtctggccgcgcccgggaccaacaagcacgccgtcgagggctccaaccccatctggaacgagaccatcaaagcgccggacttcgatgcgatcagcgacgtttctaacgactcggacctgatcggtatcgaggacctgccgcagttccgcaacgactacttccctcccgctgacgacagctccctgaggggcatcgtacttgataatcagaacaacgacacggtggcgactcacggcaacaacttcaagttcaacgctagccccttcagcccggagttcgggaacacgcccatccggagataa

SEQ ID NO: 6 - DNA, 1350 bp, Trichoplusia ni
gctggcaacaccttccgtttgtcccgtgagcaatcgacagtgaacggcgtgttggtccgcgtggacgggcagagcttcccgcgcgtgtcggccaccgacgaggacgggctgcacgccggcagcgtcagcttcagcgtcgtcggggctgccgctgaatacttctccatgcgtaacttcgaggacaacactggcgagctttacctgtcgcagcccttgcctctggaagacgatggatttgatatcaccatccgcggttctgacgcgggcacagagccgggctcgctgttctcggaggtgagcttccgtctggtgttcgtgcccacgcacggggaccctgtcttcagcgtcagccagtatactgtcgcttttatcgagaaagaggctggtttactggaatcccatcaactgccgagagctgtggacccgaagaactacatgtgtgaggaaatgaacgagccttgtcatgagatatactacagtattatcgataacaacgaggagggttacttccaagtggactcgaccacaaacgtgatctccctatcccgcgagctggagcgggcctcgcaggccagtcacgtggtccgcgtggcggcttccaacactctgctggatccggctgcgccacctccgctgcttccatccagcactttcctgctcaccatcaatgtccgtgaggctgacccgcggccagtattcgagcgtgagatctacaccgccggcatctacgagacggatacatccaacagggaactactcactgttcatgcgacacataccgaaggcctagacataacgtacacgatggacctggacacgatggtggtggacccctcgctggagggcgtgcgtgagtccgccttcacgctgcacccgagcagcggcgtcctgtccctcaacttcaacccgagcgccactatggtcggcatgttcgagttcgatgtcgtggctacagacacccgtggtgcagaagcccgtactgacgtgaagatctatctgatcactcatctcaacagagtctacttcttgttcaacaacacgctggatgtcgttgactccaaccgtgctttcatcgcggacacgttctcgtcggtgttcagcctgacgtgcaacatcgacgcggtgctgcgcgcgccggacagcagcggcgccgcgcgcgacgaccgcaccgaggtgcgcgcgcacttcatacggaaccacgtgcccgccaccaccgacgagatcgagcagctccgtagtaacacaatactgctgcgtgcgattcaggaaaccctgttaactcgcgagctgcatctggaggactttgtgggtggctccagcccagagctgggcgtggacaacagcctcaca

SEQ ID NO: 7 - DNA, 2949 bp, Pseudoplusia includens
atggcgaatcgctttaccttcctcctcttgggggtggccctggcccagggtatcctggcttacagccccatcgacctgccagaggacgaatggctagaatataggaatctgatgagggattctaactaccggctcccgagaacaactgaacctgaaacctacaaagttactctaacgccatatttagaggcatctgatggagtcaaacaattcactttcgatggtcaggttgagatactcattgttgccaaggaagctgtttcggaaatccttctacattgcaatgatttgcaaatttcggtactaactgtctcggcacagtctgccgacgcgaatttggtcgaacccggtcaaaccttcaactgcgaagacaatacaagctttttgagaatcaaaaccgcttcgcctttggtggctaattccaaatacgtgataaagagcacatttacgggtaacctccaaactaacatgagaggtttttacaggagttggtactacgacaacagtaacactaagaaatggatggccacaactcaattccaacctggtcacgcccgtcaggctttcccctgctacgatgaaccttctttcaaagcccgttttgatattacaattataaggccaacaaccttctcagacactctatcgaacatgccgatcaaggaaaaggggaccgaagtaaacggcagaattcctgagactttccacactacaccgaagacttctacatatttgcttgcgttcattgtgtcccactatgttcccgtttctactggcaccacccctaacagacccttcgtaatttatgctcgcaacaacgctggcactactggtgattggtccttggatgttggtgaacgtctcctcgacgagatggagaaatacacaggaatagaatactacaaaatggctgattacatgaacatgaaacaggctgccatccctgacttctctgctggtgccatggaaaactggggccttttgacatacagagaagcccttatcttgtacgaccccagacactccaaccatttctacagacagcgtgtagccaacatcgtgtctcacgaagttgctcacatgtggttcggaaacctggtcacttgcgcctggtgggacaatctctggctgaatgaaggattcgcgagattctaccaatattacttgacacacagggttgaaccaaaattaggttacgacacccgtttcatcgtcgagcagcttcacacctccttgctctccgactctagtgccaacgcacatcccctgacagacgaaagcgtcagcagtccgactaccgtcagcgcgcacttctcaaccatcacctacgccaaaggagcctccgtcctgagaatgacgcagtacttgcttggtgtcgaaacctacgaaaaaggtcttagaaagtatcttgaagaccacaaatatgatgtcgcaacacctgatgatttgttcaatgctctgcaaaacgctgcaacagatgacgcagctttgagccaatacgccggtgctactgtcaaggaatattttgaaagttggacacagaagcccggtcaccccctactgacagtcgccgttaataacgatggaacgatgcaaataactcaggaacgctttggcctcactccatctacagcaacgcaaggcctttggcacattcccatatcttggactagacaaggcgaagttgactttgacaatcttaaaccatcacagattttaactgcaactagtatacaagtagatgtaggcactactgaaagaggttggcttattttcaacaaacagcaaactggtttctacagagtgaactacgaccctactacttgggcacacaacactatggctcttaggaatagtgaggaaagggccaaaattcatgaattcaaccgtgcccagatcgtggatgacgtattcttgctagccagatctgaaaggatgaactacagagttgcgttcaacattctctcgttccttgaattcgaagatgcgtacgcaccttggatcgctgctattgccggattcaactttgctttgaggagatttgctcatgatgaagttgcattagcgaagttacagtcacacattcacaccgctgccacggctgttgtcaaccgcctgggcttcgaagacaagggtggagacgataattacatggacgatctcctgcgcatgtacgtcatgcagttcctctgcaatgctaaacacgaaaaatgtgttgaagaaggagtaaaattattccagagctggaaagcggacccacaattccacatccccgcaaaccatcgtccatgggtctactgcgctggtctccgagctggcgacgcttctgatttcgatgtattctgggcacgttacctcgctgaaaccctggctagtgagaaagtggtcatggttactgcagccggttgtactggtaacgaagctagcttacgcaagttcttggattccattgtcgatgacgaggaagacattagacctcaggactactctgttgccctaaactcagccataactggaaacgaagttaacactttgagagccttcgaatggttgaaggataacattggccaaacagcgaaaacgcttggcagtatcaactctcctctctctaccatcagcagtcgactgttgaatgaggaacagattaatacagtcgatacctggctgaccgcacaagctactgtaatcggcacatcagctgtcaacgctggcagggctggtattgagacttctaggaacaacatcgagtggctgaataagaggaagagcgagttcgaggagtacttcgaaagcgggttcgatgatcctttggtcaccccgcctgctgagacgacgacgcccgcatcgacctctgcgccaaccaccacggaagcccccgcctccgcgcacactgccgctcttagcgtcgtcaccctgttggtcacccttgcagtcaacatgatcaactaa

SEQ ID NO: 8 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggactttgaggctcctaatatgcagcgctactcgttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacatgaacccgctggagaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 9 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggacttcgaagctcctaatatgcagcgctactggttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacatgaacccgctggagaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 10 - DNA, 5322 bp, Pseudoplusia includens
atggaagtcgacgtgcggatcacgacggcagcgctgctaatattcgctgccacccttgtcagcgcacagactaatcaattacgatgcacttatattcaggaaatacctaggggagatacaccagttttcaactttcccagttttgatggagtgccatggtcacagcagcctttgttaccactcccgcagcgggaggagctctgcatggaagacccagtctctgcggggagctccgtcatcatgaccatttacatggaggaggaaatcgaggaagaaatagccattgctaagttaaattataaaggcactggaactccggaaatcgggccagccttcacgacaggtagtttccacacgctcggtcccgtctttcgtcggatccctgaagatggcgaatggcatcttgttatcactaacaagcaggacttcgaagctcctaatatgcagcgctactggttcgatatctcggtgccgggcgagtccgtcggcctcatggtgctgctggagatcgtcaacatcgacgacaacgctcccatcgtacacatgatcgaccgctgcgagatacccgagccgggtacacacgggcgtacggcctgtgcttacactgtgtcggacgcggacgggcgcatcagcacggagttcatgacgtacaagatcgatagcgaccgcaacgaccaggacttcttcgagttggtcaacgaccacaccatggacgcagacgaaaagatcacccacatggtcctctacctacataaagacctggacttcgaagttaaccctcttcatatattctccgtcacagcttttgactcgaagccgaacgagcacgaggtgaccatgatggtgcaagtccagaacacggaccgtcgcaacccgcgctggctggacatcttcgccgtgcagcagttcaacgagaagaccacgcagaggttccccatccgcgccatcgacggcgacacggggatcgatcgacaaatacactacaggctcgaagcagacgaagaagacaccttcttttcgctggagctagcagcggatggtaacggcgcagtgcttgtcgtcgacgagatagacagagacactctcatgagggaagtgttccagctctccatagtagcgtacaagtacggccccaatgatgaagaggacaggccatccttcgagaccagagccaacatcgtcatcatcgtcatcgacgtcaatgatcaacgtcctattcccttcaaacaaattgatgatgataataataatgatgatggtgatgacagtagtgatgatgatgaagacagctcagctgattccagccgcaatgagcttgctcctgaggttcctgaagaccccacaattcgcatctataagatcacaatagaggaagagacgcctatgacgctcaatttacaagatttcggtttccacgacagagatctcggtgagaacgcacaatacgaagtgcacttggagagtatctcgccggaaggtgcggaggaagctttctctatctcgccaaccagggggtaccaggaccagtcgttcattgtctccaccaggaaccacagacttctggacttcgaagtggaagagttccagaagatccggctgagggtgatagcaatagacttgaacgacactagcttgaggggcgaggcgtggctgcacatagacctggagaactggaacgatgagatgcccatcttcgggcaagatgtgtatacggcggagttcgacgagactgtcggcgaagggttccctgtggctaccgtcagagctactgacagagacatcggcgatagagttgtgcattcactgctgggcaatgctggagactacctgactattgaccctgacaccggggagatattcgtcgctcacgataactacttcgacttccatcggcagaacgagtactttgttcaggtgcgtgcgacggacacactgctggatacgaacaacacagccacggcgcagctcaccatcaaactgcgcaacatcaacaacacgccgcccacgctgctgctccctcgtttcagtcctgaagtgaaagagaacgtgccggaagacttcgtgatcccggcggacatcgaggccacggaccccgacctcgacgcgcagctggagttcgagatagactgggaacagtcctacgccaccaagcagggcaggccgacacctgctattgagttccataattgcttggaaatcataacggtccccactgagtcccgtcaccgcgttgtagggcggctcgacgtgcgggagatcaggacaggcgtcaccattgactacgaggagttcgagatcctgtacctcagcatcagggtcatcgacaggaacactgtacctggcgctattgattacgctgaatccatcctcgcgatcaacataatcgacatgaatgacaactggccgatctgggcggcggggcagctgcagcagtcgctgcgcgtgcgcgagggctcggccgctggtgtcgtcatcggctcactactagccacggacatcgacggcccgctctacaacaaagtgcgatactcgctcgtgccgataggagagactaagccggacctagtgacaatagaccctatcttcggtcagctgacagtcctgaccggagggcagatcgacgcggacgagcccaagacgtgggccctggagtacaccgtgacggccagcgaccgctgcgtagaggacgacggcttcccttgcactggggacgaccccactgtatggaacactgagggatatttgtgtatcgacataatagacacgaacaacaaaagcccagagacggagaacgcgaacatcacggtgtgggtgtgggagaacgccacggagggagacactgtcgcgcagctctccgccacagacctcgacagggacgagctgtaccacacggtccgctaccagatcctgtactcggtgaacctccgcctgctgaacttcttcgcggtggacctggacaccggcctcatcacagtgcactaccccaccaacgaggtgctggacagagacggcgacgagcccgaacacaccatcttcctcaacttgtttgataacttctattttgatggagacggacagcgcaacatggcggagaagacagtgcgcgtgcgcttactggacgtgaacgacaacgcgccggaactgccgccgcctgacgaactctcctggactgtctccgaggacgaacccgctgaaagtcgtgtgctaccagaaatctacgctccggatagagacgagccggacacggataactctcgggtcgggtacgcgatcctcggccttgaggtgaaccgggacatagaagtcccggaactgttcaccatggtacagatagagaacgtcaccggcgagctcgagaccgcgatgcatttgaaaggattctggggcacttatactatacacatacaggcgtacgaccacggcatcccgcagcaggtgtcggaggagaggtactcgctggtggtgcggccctacaactaccacgcgccggagttcgtgttcccacaacaaggcgccgtctacagactgtccttggagcagtcgacagtgaacggcgtactagtacaagtgtccgggcagagcttcccgcgcgtcacagctacggatgaagacggactgcacgcgggggctgtcactttcagcgtcgtcggagctcccggcgaatacttctccatgcgtaacttcgatgataacaccggcgagctgtatctaacgcagcctttagtcaacacggaattagatatcaccatccgcggcacggacggcggcaccgagccggactcgaagttctccgagctgtccttcaggctggtgttcgtcaccacgctgggagaccccaccttcgctgtagaggaacacactgtcgcttttatagaaaaagaggctggtttactggagagcttccagctgccaactgctgtggacgcgaagaactacttgtgtgaggaactgaacgagccttgtcatcagatatactacaattttatcgagggcaacagccagggttacttccaagtggaaccgaccaccaacatgatctcgctaacacgtgagctggaccgcgcggtggaagcccggtatgtgctgcgcgtcggcaccagcaacgcgcccatcgacccctccgcaccgcccacactcatggctgcctccacactactgctcaccgtcaacgtgcgcgaggcggacccgcggccgctgttccagcgcgacatctactctgccggcatctacgagactgacgtcaccgggaagttactgctcactgttcatgcgactcacaccgaagggttagacataacgtacagcatggatatggagacgatggaggtggacctgtcgctggaggccgtgaaggactccgccctcatcctgcatcccactgagggcagtctgaccctcaacttcaacccgacggcgaacatggtcggcatgttcgaattcgatgtggtagctactgatactgcgggtgctacagcccgtactgacgtgaagatctatctgatcacgcacctcaaccgcgtcttcttcacgttcaacaacacgctggatgtcgtcgacgccaacagagagttcatcgcggacacgttctctttgggcttcagcctgccgggcttccgcctgacgtgcaacatcgacgcggtcctgcgcgccaccgacagcaacggcatcgcgcgcgacgaccgcaccgaggtgcgcgcgcacttcatacggaacaacatccccgccaccaccgaggagatcgaagagctccgcagtaacacactgctgataaattcgattcaggagaccctgttcactcggtcgctgagcctagaggacttcgtgggtggtgccagtccagagctggaggcggacaacaacctcacggtgtacgtgctgagcgcgctcaccgccatgctcgggctgctgtgcctgctgctgctcgtcaccttcatcatcaggaccagggctctcaaccgtcgtcttgaagcattatccatgacgaagtatggttcagtggactctggtctgaaccgcgcggggctggcggctcccggtaccaacaaacacgccatcgagggctccaaccccatctggaacgagaccatcaaggccccggacttcgatgccatcagcgacgtgtcgaacgactctgacctgatcggcatcgaggacctgccgcagttccgcagcgactacttccctcccggcgacgaccactcgctccagggcatcgtgctcgacaaccagaacaacgacacggtggcgacgcacggcaacaacttcaagttcaacgcgagccctttcagccccgagttcgggaacacgcccatccggagataa

SEQ ID NO: 11 - DNA, 3045 bp, Helicoverpa zea
atggcgaaccgctggtacaccctccttttgggggccgctcttctgcagagcgtcctctccttcggtcctattgaagtgacagacgacgaatgggctgaatacagaaacctgatgcgggaccctgcttaccgcctgcccacgactacgaagcctagcaactacgccgtcaaccttacaccatacttcactggcaccaccttagctttcacctttgagggctcagtacgcatcaccattacggccacgcaggctaatgtcaacgaaattgtgctccattgcaatgacttgaccatcgaatcggtcatggtggctaccgaagctagcccgaatgttaatcttattgcaagcggacagacttttgtctgcgatcctgtatacagtttcctaagaataaggaccgcatcagccttgaatattaacacgaattatataatcacgagtaacttcagaggcaaccttcaaacgaacatgagaggtttttacaggagttggtatgtcgactctagtggtaccaagagatggatggcaacgacccaattccagcctggccatgctcgccaagccttcccctgctacgacgaaccaggattcaaagccactttcgatattaccatcaacagggaagccgacttcagcccaaccctttccaacatgcccattagaaccacaactcccctcgcaaccggcagagttgctgagacgttccacaccactcccgaaacatctacgtacttgattgcttttatagtatcgcactatagtcaagtagcttcaaacaacaaccagcagaggcctttccatatctatgctagagacaatgttggggtccatggaaacttcgccttggaaattggagtgcctctcttggaagtcatggagcgctatacagaaataccttactatggcatggctcaaaacatgaacatgaagcaagctgctatccctgacttctcagctggtgccatggagaactggggacttttgacttacagggaggctttgattctgttcgatcccgtgaataccaacaacttctacagacagcgtatcgccaacatcatttctcacgaaatcgctcacatgtggtttggaaacctcgtcacatgcgcttggtgggacaacctttggctgaacgaaggttttgcacgattctaccagtactacttgactggcgtggtcgctcctgaaatgggcttcgaaactcgtttcatagtggaacagctgcacgtgtcgatgttgtctgactcccttgactctgctcacgccctcaccaaccccaatgtgaacgaccctactactgtcagcgcacacttctccaccatcacttatgccaaaggcgccagcatcatcagaatgacacaacacttactgggcaacaacacttttgtgaaaggccttaggacttacttgaaagacaatgcctacggtgtcgctgagccccgtcacttgttcactgccttagacgctgctgcaaccgcagacaatgctctcgccaactatggtggtatgaccatcgatcgttacttcagaagctggtcagagaaagctggtcatccattgttgactgtgtccattgaccactcctctggacgtatgaccattattcaaacccgatttgagcgcaatactggtgtatcaacagcgaccgacagtctttgggacatccccattacttggactagggcaggatctattgactttgacaacctgaaacctacgcaattcatcagtggtgttttgactatcatcgacagaggaaccattggcagggaatgggttattttcaataagcagcaaactggtttctatagagttaactacgatcaaatcacttggggtctcatcactcaagctcttaggagtaacgtgaggctatcaatccacgaatataaccgtgctcagatcgtcgatgacgttatgttgttagctcgagctggcattatgacctacagcagagccttgaacattctctccttccttaaatttgaagatcaatatgctccttggggcgcagctattactggattcaacttcgccctccgaagattagctcatgatgttacagctcaccagaaactgaggaatgaaatcttggatttgagcacggccatcgttaatcgtttgggcttcagcgagccagctgttagcaatttcatggacgaccttctccgcatgaacgtcatgactttcctttgtgacatcggccaccaggggtgcatcactgctgctagaactagctttgctacctggaagaacggtggagttgtcccacccaacatgcgtccatgggtgtattgcaatggagtgcgctacggagatcaatctgacttcactcacttgtggaatcgttacacagcatctgacgttgctaacgacaagctggtaatgttgtcggccgctggttgcactcttaaccaggccagcttgaacatattcctcaatgccatcgtgtctggaggcgatgacatcaggcctcaagaccacagcgcagctatcgcagcggctgtccgcagtaatgaagtgaacactatgagagtattcacatggctgcaagctaatgtgcaacagactataaacactctgggaagcgtcagtcctattttgaacgaaatcacagctcgcctattgaatgaagcccaaatcactcaggttcaaacttggttgaatgcaaaccagaacttaattggtactgcagctcacactagcgccacaaatggcatcgccacgtctaggtccaatattcagtggtacacacagagggttcccgaattcaacgtatactttgaaactggatatgttgaagaaaacttcgctgacactacaactaccagtacgactacgactacgacaactactacgaccactacagcagctcctacgactacgacaactacagaggcgcctacgacaacaactacgaccactacgggagcgcctacgaccacaactacagaagctacaacaacacctgtacctggctcagcaaacatcgccactcttagcatcgtcacaatgatcgtgactctcgttgttaatatggcttaa

SEQ ID NO: 12 - DNA, 1608 bp, Helicoverpa zea
atggtgacactgttcccgtacgtagtggcggtgctgtgcggcgcgacgagcgtgcgcgcctactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgcgcgcacgctgctcggacagcgccaagggaaaacgggagaggagacaaagttgcatttcgagactttccccacaatcggattagtgaagacgtactgtgtggacgcccagattgcagactccgcatgtactgccacagcgtatttgtgtggtgtaaaaaataactatggcgccataggcgtagacggcacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatttttggtggtggcaagcgtgcctttttgccaaatactgaacaggacgaaaaacgatcttatggtagaaggatagataaccggaatcttatcaaagagtgggaggatgataaggtttctcgtaatgtcagccatcaatatgtttggcaccgcgagcagctaatgcgtctaaaggaggacctgcctgaatacatgttgggactgttcgagagcagtcatatgacctatcacttgaaatcagaccctcagtctgaacccactctcgctgaactaacagaggtggcaattcggtcattaagacgcaatgagaagggattcttcctgttcgtggagggggggcgcatcgaccacgcgcaccacgacaacctggtggagctcgcactcgacgagacgctggagatggacaaggccgtggccaccgccacggagatgctctcagaggacgactcgctcatcgtggtcactgccgaccacgcacacgtcatgactttcaatggctactctaaccgtggtcataacatcctcgggccctccagggatgtcggactagacaatgtgccttacatgacgctaacgtatgccaatggacccggattccgtccacacgtaaacaacattagaccagatgttacccttgagccaaactatcgcactctggactgggagtcgcacgtggacgtgccgctggtcgacgagacgcacggcggcgacgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcttcgtagctctgctcgctctattcacttccattttactgcgataa

SEQ ID NO: 13 - DNA, 1608 bp, Helicoverpa zea
atggtgacactgttcccgtacgtagtggcggtgctgtgcggcgcgacgagcgcgcgcgcccactggctgcatcccgcggcgccggccgccgccagccgcgccgagacctctgccaactactgggcgcaagacgcgcaggccgccatcaacgctcgcctggaacgagttgaaagcgtgaagaaagcgcgtaacgtcatcatgttcctgggcgacggcatgtcggtgcccacgctcgccgccgcgcgcacgctgctcggacagcgccaagggaaaacgggagaggagacaaagttgcatttcgagactttccccacaatcggattagtgaagacgtactgtgtggacgcccagattgcagactccgcatgtactgccacagcgtatttgtgtggtgtaaaaaataactatggcgccataggcgtagacggtacggtacgccgaggagactgtcaagccgcttcaaacactgcgacacacgtcgagtccatcgcggagtgggcgctcgctgacggacgagatgtcggtattgtgacgacgactcgtatcactcacgcgtctccggcgggcacgttcgcgaagacggcgaaccgcacctgggagaacgacggtgaagtgtcgcagatgggcttggacgccaaggactgccctgacatcgcgcatcagttggtacaccatcatcccggtaacaagttcaaggttatattcggtggtggcaggcgcgcctttttgccaaacacagttcaggacgacgaagggtcttatggtaggaggatagacaaccgcgaccttatccaggagtggaagaatgataaggattctcgtaatgtcagccatcaatacctttggcaacgtgagcaattaatgaacctgaatgatgacctgcctgagtacatgttaggtctgttcgagagcagtcatatggaatatcacttgaaatcagatcctcagactgaacccactctcgctgaactaacagaggtggcgattcgatcattaagacgcaatgagaagggattcttcctgttcgtggagggggggcgcatcgaccacgcgcaccacgacaacctggtggagctcgcactcgacgagacgctggagatggacaaggccgtggccaccgccacgaagatgctctcagaggacgactcgctcatcgtggtcactgctgaccacgcacacgtcatgaccatcaatggctactccggccgcggtaacgacatccttggaccctccagggatgtgggacgtgacagaatgccttacatgacgctatcctacactaatggacccggattccgtccacacgtgaatgacatccggcaaaatgttactgcagaaccaaactatcgcactctggactgggagtcgcacgtggacgtgccgctggtggacgagacgcacggcggcgatgacgtggccgtgttcgcgcgcgggccgcaccactccatgttcacggggctgtacgagcagagccagctgccgcacctcatggcctacgccgcctgcatcggccccggccggcacgcctgcgccagtgccgcgcacttgcctagcgcgcacttcttcgtagctctgctcgctctattcatttccattttactgcgataa

SEQ ID NO: 14 - DNA, 3042 bp, Helicoverpa zea
atggcggcgataaaactcttagttttatccttggcttgcgcatgtgtgattgcgcactcgcccatccctccagtcagcaggaccatcttcttagacgagcgtcttgaaggaggtgccttcgagaatatcgacgccttcaagaacatcgaactgagcaacgccgccgcttctccctaccgtctgcccaacactaccttccctacccactacaaagtattatgggttatcaaccttagtgataacgaacaaacctacagcggtaccgtcgatattactcttcaagctacacagccaaatgtcaatgaaattgtcatccactgcgaccacttgacggtcacctctgtggtcttgaggcaaggaacggcaacggaaggaacattgatccccaccacccctacacctcaatctcaataccacttcttgagggtcgcacttaatgatggcgttctcttgtataatgaaaatgtccccgtgcaatataccctttccattgcattcaatgccgaaatgcgtgatgacatgtacggtatctacagaagttggtacaggaacttgcccacagataacaatatcaggtggatggcaacgactcagttccaagccacagctgctcgctacgctctcccttgctacgacgagccagggtacaaggccaagtttgacgttacgatcagacgccccttaggctacaaaagttggttctgtaccaggcagcggatcaccagaccatcaaccactggttacgcagaagatgagtatcacactaccccggaaatgtctacctaccttctagctttaattgttgctgactacgactctcttgcaactctcgatgctaacgatagagttttgcatgaagttattgcaaggcctggagcaattatcaatggacaagcagcctatgctcaaagagctggccaagatcttctaggaaatatgagcgaccacacgggctttgacttttacaaacaggacgaaaaccttaaaatgactcaagctgctattcccgacttcggtgcaggcgctatggaaaactggggcttgctgacttatagggaagcttacattctgtatgacgaacaacacacgagcagcaacttcaagcaaatcatcgcttatattctctcccatgagatcgcgcacatgtggttcggtaacctagtcaccaacgcctggtgggatgtgttgtggctgaacgaaggttttgccagatattaccagtatttcctcactgcatgggttgaagacatgggtctcgccactcgtttcataaacgagcaggtgcacgcatctttgctcagtgactcgtcaatttacgcccatcctctcaccaaccccggtgttggtagcccagccgccgtcagcgctatgttctccactatcacctacaacaagggtgcttctgtcatcagaatgactgagcatcttctcggctttgaggttcatagggcaggtcttaggaaatacttggaggatatgaaattcaaaacagttcagcctattgatttgttcactgctctggagactgccggtaacgatgcaggtgccctcgacgcttatggagatcacttcgacttcgtaaagtattacgaaagctggacggaacagccaggacaccccgtgcttaatgtgcacatcaatcaccagaccggacacatgaccatttaccagcgtcgtttcgacatcgacactggctactcggtccaaaacaggaactacattgttcccatcactttcacgaccggagccgatcccgacttcagcaacacgaagccctctcatgttatctccaaggctgttaccgtcatcgaccgtggagtggtcggtgatgtctggaccattttcaacattcaacagactggtttctacagagtcaattatgatgattacacctgggacttgatcatacttgccttgagaggcgctgacagggaaaagattcatgaatacaaccgtgctcagatcgtcaacgatgtattccaattcgcccgttccggcctcatgacgtacgaacgtgcattgaacattctctcttacttggaaaatgagactgattacgccccatgggttgctgccattactggcttcaactggcttagaaacagattggttggcaaacctcagcttgcagaacttaatgcaaagatcgtccaatggtcatcgaaggtaatgtccgagctgacatacatgcctattgaaggagagcccttcatgcggtcatacttgcgctggcagctagctccagttatgtgcaacttgaacgtacccgcttgccgcgctggtgccagagtcatcttcgataatcttcgtctttatcaacacgaagtaccagtggacagccgtagctgggtatactgcaacgccctccgtgatggtggagccgtggaattcgaccacttgtataataggttcaaggcacacaatgtctacactgagaagatcctcatccttcaaacccttggctgcacaagtcaccctgcctctttgaccacattgctgaacgatattgtcacgcccaacaatatcattcgtccgcaagactacaccacagctttcagcactgctgtttcaggcaatgaagaaaacacactctttgttctcaattacatccagaataacctggagactgttttgaaagcctttacgtctccaagaacacctctatcctacatcgcggctaggctgaggacagttgaagacgttaccgcgtaccaaacttggctgaaccttaccaccactcgcgaggtccttggtaccagttacaataacatctacggagactctgttgccgcttacaacagcatcctttgggtggccaccgttgaggattccctctccgcctatctcactaacggagataacgtcattcagcccactacttctactaccactaccacggttgcaccaaccacagttactcagccccctatcacggaaccgtccactccatctctgccagtaccagtgaccgacggagcaatgacgagcttcgcatcactcttcatcatttcattgggtgccattttgcaccttattttataa

SEQ ID NO: 15 - DNA, 4080 bp, Spodoptera frugiperda
atggatacaaagaaaggaagtaaaaatgactcgaaatccaaaccgccgccgcctaaaccaaagagtgtgccaaacgtgtttaagaggacatttttctgctggatgctgcctatattttactttggcaaccgcagagacctggaggaaagtgatcttccacctcccaagaatatgtatcaatctaagatgctcggagataaattggaaaggagttggctgaaagaagaacatgaagcgaaactagccggacgaaagccgaaatttacgaaggttttattcaaaacattcatttggtcttatataccgggcggtttaatgcaggctacctcaattggcctacgcacggcatctccgctgctgttcagtcaactgctccggtattgggcagctgactccccggtggaccgggagacggccatgtactacgcgatcagtatgatcctcgccaactgggcgtcatccttcatgaaccaccacggagtactgttctgtcagcagtttggtatgaagctgaggtgtgctgttggatctttaatgttcagaaagataatgcgtatgagcaacggctctttaggcgacactgcagcgggtaaggtagtgaacatattatcgaacgacctgcagaggttcgacttgtcaatggtgttcctccactacgtatggattattccgctacaaattgccgcagtcatatatctgggctacctacaagctggaaccgcggctttcattggattcgctgctttaatcatcattgcgttaccattccaaggtggtttgggccagtacctaggtaaaattcgacttcgcaccgctgaaaaaacagacaacagaattaaaatcatgagcgaagttataaacggaatacaggtgattaaaatgtacgcatgggagattcctttccaaaaagtggtcggtcagaaacgtgcggaagagctgaaggaagtgaagattgcaaccatcttgaggaccgtgttcttaggatttatgatgttcacggaaagagctgcgcttttcttcactgtgctcacttatgtcttgttggggaacgttatgtctgctaatgtgttctacccgctgcagcaatttatgagcgccgctcaagtaaacattacattaatcttgcctatggtgctatcgttcactgctgagctcttcgtgtcccttggaagagtcgagaagttcctgttactagaggacaggccagacttgaaggggcatccggaagaaacatcgtccaatttattccgcaacatgtcggccgatggcattccggagaccaacggctctatccgaccgctctcttaccatcggaaatctgaagcatcaccaatagagccgggtagtgagatacagctgaaggttcctaagtttacacggagtgtgtcgtatcaggaggactcagcgctagtgttgcacgatgtgtcggcgagttggaccggagacccgaacatgatggcgctgaagaacatctccatgcgactgcggaagggcaagctgtgcgctatcattggtgcagtcggctctgggaagtcctcgattttgcaactactactaaaagaattgccttcggcgactggcactatttcaatatacggcaagatgtcgtacgcttgccaagaggcgtggctgttccccagcactgtccgggagaatatacttttcggtttgccgtttgaacccggaaaatataagaaggtgtgccgagtgtgtgcactcgagaaggacttcaagcagttcccgtacggggaccagacgttggtgggggagaggggggtgtccctctccggaggccaacgtgcccgaatcaatttggcgcgcgctgtttacagagaggccgatatttaccttctcgatgatccgctgtcggctgtggacgctaacgttgggcgtcagctatttgagggatgtatcaacggttacctgcgtgggcgcactaggatcctggtcacacatcagattcacttcttgaaagctgctgattacatcgttgtactaaacgagggccgtattgaaaacatgggaacatttgacgaattggtttcgtccggcaaagaattcgcaatgatgctcgcccagctacaggaaggcaaagaaaaggacacggagagtgttggctcacggagtatcgaagaaaaagagaaaccagctctgaagaccatgatcagtgtgaatgaaggtgaggaggtacaagagtttgaagcgcagaagatgaaggaagaagagagacaatctggcaacctccgctgggaggtgatctctgcgtacttccgatcgggagggcacgtctgtttcatcctatttgcactcttggtcgttgtactggccactacctgcgccgcttctgttgactactgggtcagttattggaccaatcaaatggctgcatacgaggagtccttgggcggagaaagtatcgagcctggcttggacgtgcaggcgggtcggttcacagtgggacagtatctgacaatccacggctgcctggtggctgccttggtgttgatggtcaacctgcgagtcttccccttcgcctacctctgtgtctcggcctcagccaaactacataaccagatgttctcgactatgctgagaggagtcatgaggttcttcgacaccagttcctcaggtcgtatcttgaatcgttttaccaaagacatgggttctctcgatgagatcctgcctcgtaccttactggatgtactgcagatctacggaaccttgactgctatcctggtactcaacgccattgctctatactggaccctggtaccttcagcagtactcctagtgttattcggctttatggtacgaatatacttgaaggcagctcaaggcattaaacgattggaaggcacaacaaagagtccaatgtttggaacagtgacgtcatcgttgagtggtatttccactatcagggcatccaatgctcaagagagattgatagagcagtttgatatcaaccaggatctgcacactacttcgtggaacagttacttgaatggaggaacgacgtttggtttctatttagatacaatgtgcctggtatacatgaccactatcatattcgtgttcctcttcatcgatttcggggacgccatcccagtgggcagcgtaggcctggcggtgacgcagagcaacacgctgacgctgatgttgcagcacggcgcgcggatgttggtcgagttcctcgcgcagctcaccagcgtcgagcgcatcctcgagtacacgcgcatcgacaccgagccagacttgttccaaggaaaggttgaaatgccgccaaattggccctaccaaggaaggatcgagtttcagaacgtttctttacggtacgcgccgaacgaacaacccgtccttaaaaatttgaacattgttatcgaaagcggaaacaagatcgggatcgtggggcggacgggcgccggcaaatcttctttgatatcagcattattccgattcgcctacctcgatggattaatatccatagatggactcgatacttcgctgatttcgagacagggactgcgatcgaaaatttcaattattccgcaagaaccgatcctgttttccgcgacaatcagatacaatttggatccgtttgacatttacagcgacgacgacctctggagagccctcgaacaggttgatttgaagtctgctgtaccgtccttggacttcaaagtaacagaaggaggttctaatttctcagtgggccagcggcagctgatgtgtttggcgcgcgctgtgttgagatccaatcagatcttaattatggacgaagctacggcgaacgtagatcctcagacggataacttcattcaggagacgattcgccggcagttcgtgtcgtgcaccgtgctgacgatagctcacaggttgaacacgatcatggactccgacaaggtgctggtgatgagcagcggccaggtggcggagtacgaccacccgtacgtgctgctctccgaccctaacagtcacttctctgccatggtgcgggagaccggcgagaagaacagtgctaacttattccaagtagccaaagacgcttacttccaaagtaatctgaaagaaaacgcgagataa

SEQ ID NO: 16 - DNA, 1626 bp, Spodoptera frugiperda
atgaggtcgctactgacttacctagtggccgccgtggtggtggcggcgtgtgtccgcggggaccggtaccaccccgcggaccccggcagcagagctgacaccgttgtgaaccgtgccgagacctcagccaactactgggcccaagaagcgcaggctgcaatcaatgcccggctggcgcacaaggagagcgtgaagaaggcgcgcaacgtggtcatgttcctgggcgacggcatgtccgtgcccacgctcgccgccgcgcggacgctgctcggccagcgccgcgggcacaccggcgaggaggataaactgcattttgaaacattccccaccgttggattgactaagacgtattgcgtgaacgctcagatcccagactccgcgtgcactgctactgcgtacttatgtggtgtcaaaacaacttacggagctattggagtgaatgcggaggtgccacggaaaggctgcgaggcgtccaccgacaccagccgacacgtggagtccatcgccgagtgggcgctggccgacggccgcgacgctggtatcgtgacgacgacgcgcatcacgcacgcgtcgccggccggcgtgtacgccaaggtggcggaccgcaactgggagcacaaccaggcggtggagaacgatggcttcgacacggacaagtgcccggatatcgcactgcagctcgtgcataagcaccccgggaataaactcaaggttattttaggcggaggaagactaaactttttgccaaatgatgtgaaagacgaagaaggggtatatggaaaccgaacagacacccgcaacctcatcgaagaatgggcacaagacaaggaagatcgtaaagttactcataaatatgtttggaatcgtgagcagctgatgagtcttaaagatgatcttcctgagtaccttttaggacttttcgaaagtaatcatcttcagtacaacatgcaggcagatcctaatactgagcccacgttgactgagctaactgagatagcaatcaagtcgctaagtagaaacgagaaaggttttttcctgttcgtggaaggcggtcgtatcgaccacgcgcaccatcgcaactgggtagagctagcgctggacgagaccctggagatggacaaggccgtcgcgcgcgccgccgagctgctctccgaggacgactcgctcattgtggtcacagcagaccactcccacgtcatggcttacaatggatactcggcccgtggacatgacatcctcggcccttccagagacttggacctggacggagtgccttacatgacgctgtcgtacaccaacgggcccggcttccgttcgcatatgaacggtatacgccccgatgtcaccgctgaagacggtttcggagaagacgaatggttggctcacgtagatgttccgctgatagacgagacgcacggcggggacgacgtggcggtgttcgcgcgcgggccgcaccactccatgttcacggggctgtacgagcagagccagctgccgcacctcatggcgtacgccgcctgcatcggccccggcagacacgcctgcagcggcgccgcgcatgcgctggcccagcctgtgctgctgctctctctccttgtactgctcacttcactattccaacaatga

SEQ ID NO: 17 - DNA, 3066 bp, Spodoptera frugiperda
atggcgagtcgctggtttaacctcttattgggggtcattttactccagtctgtgctggcgtttggcccaatcgacgtcacggatgccgaatggattgaatacatggggctgattaataaccccaattaccggttgccaactaccactagaccattacattacaaagttagactgcaaccaaatttagaccaagattttgagcttaacggtgatgtcgaaataaacattaaagttgaaagtgggaatcaaccaatcaacgaaatcaaacttcactgccaggatatggtaatcaacagtttgaccgtaacctcaactacaaatacccaagtaaaccttgctcagggcactcagtttgtatgcgaagaaactacttcctttttaacgattccaaccaccactcagctacttaatggaaatgagtacatcatcaagatatcatttgttggaaagttgcaaagtggtatgagaggtttctacaggagttggttctttgatgaaaataagcagaaaagatggatggctactacccaattccagcctggccatgctcgtcaagcgttcccttgctacgatgaacctggcttcaaagccacatttgatataatattggttagagacgattcacttatttcattatcaaacatgcccataagggaaactataacatctaccttatatccccagaaaaaagaggacatatactacactactcctattatgtccacatacttactggctttcatagtagcggattacaaacggatcgagtctggaacaaatgtgaatagaccattccatatctatgctcgaggtaacgttggagatacaggcaaatattctttggaggtcggtgaaaaacttttgacgttaatggaatcgtatactcaatacaattactacacaatggcttcccacatggaaatgaagcaagctgctattcctgactttagcgctggtgctatggaaaactggggcctgttaacctacagagaagctctcattctgtacgatcctgaaaacagcaacaatttttacaaacaacgcatagccaacattatatctcacgaaattgcacatatgtggttcggtaacctcgtcacatgcgcttggtgggacactctttggttaaacgaaggtttcgctagatattaccaatactacatgacggacaaggctgagccacacatgggctttaagacacgtttcatcgtagaacagctgcaaatggccatgctctccgactccttctcaaatgctcacgcacttactaaccctgcagtgtctgatccagattctgtgagtaaccacttttcaaccatcacttatgccaaaggtgcctctatacttagaatgacagaacatctgcttggtggggacacctatgagaagggtcttcgggaatatttaaagaaaagagaatttaataccgctgaaccaaaggatttattcgaaagcttggacgctgctgctaatgctgacaattctctagctgattacgatgatatgacaattgcgaagtacttcgcatcgtggtctgaaaaagcagggcatcctctattgacagttcatgtagatcacgctagcggccgtatgaccgtcgtacaaactcaatttgatgtcaacagtggtgtgtcttcggacaatggtttatggcacattcctttaacttggactagggctggaaatcctgaatttgaaaatcttaagccttctgaattcatgagtggcccactaaaaattattaaccgaggaagtactggtagagaatgggttattttcaacaaacaacaatctggtttctacagagtaaactacgacgccactacgtgggctcttcttactcaagctttgcgaagtaacgagagggaggctattcacgaatacaaccgcgctcagattgtggatgacgtgttcgtgttagctagatctaacatcttgtcctatacgcgagcgttgaacattctttccttccttgaatttgaagacaagtacgctccttgggtagctgctattactggattcaactttgcgcttcggagactggctcataagactgaagaacaacaaaaactgaaggatataatctttaaatcgagtgcggcgatcatccagcgtctcggttacaccgaggcgtccaacgccgatcctcttttcatggataacttgctccgtatgcatctgatgaccttcctttgtaacgctggacacgcgcaatgctcccaaacaggaagagaatatttcaaggcatggagagagagtgggacaagaattccgccaaacatgcgtccttgggtatattgcgaaggtcttcgcactggagatttagctgatttcgattatttctggaaccgttatgtggatgaagatttatctaacgagaaagtcgtgatgatcggtgcagctggttgcacaggaaatacagaggccttacacaaattcctcagtgtaatcgttgacccaaaaccgactgaacaatcaattgaactaatcagacctcaggactacagcgctgctattagttctgctgttactagcaacgaatacaatactatgaaagtacttgagtggcttaaggataatccttcacatcttcagaatggaaatggcgtaagtcttttacgatctgcagcaagccgattattgaacgaggctgatatttttaaggttgaaacctggtttgccactattacctcagatgaagctatacaagcgattaaagatggcattgctacatcaaataataatataaaatggtataacagtagggtaggggagttcagtgattacttcgaaacaggatattttgacgatttgactggcggatcagaaacacctgatcctactacccctgaacctactaccgctgaacctactacgcctgaaccaactacccctgaacctactaccgctgaacctactaccgctgaacctactaccgatgaatctactcccgctgaacctactaccgctgaacctactaccgatgaacccgaacctggctctgcgaatatcgcttctctcagtttcttcactttgctagtcacactcatcatcaacatggtataa

SEQ ID NO: 18 - DNA, 2297 bp, Diabrotica virgifera virgifera
atgaggacgaaattagtgatttttctgtgtttggtattgtttgtgacaagtgtatacaatgaggatataccagtgaattctttattagatgagctgcatcctgctgcagaattcagccggcatacactcgtgaaacccaaactctaccatggaagagaaaaaagacaaatttcgtcgacgaaagagaagtcgggaaaacacactgatcatctacaaatcacgatggaagtggatggagaggacatgatattagatttgaccattaacaaagatttaattcctgaaggatttttccacaaacatcaaaaaaacggagattacaaaattcatcaaccaacatttcaggaagctaatatctgtgaatacaatggaaaagttcgtggaaagcctaattcctgggtggccctttcgacctgcgacggcctctctggcgtagtattcgacggcgaagagatgcactacgtcgaaaaaggaaattcgataggcgacgtagaggccgatcattttttatatagatattccgatttattggaacacaataagacgtgcgggtatgccggggatgcggtggatcccgaaaaagctattcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggcggggtgaacacggaccattcacctgttgtcggacttgttgctaccaccgtcgcacacgaaatgggccataatttcggtatggaacacgacacgaacgagtgcgaatgcccggacgaccgttgcataatggcgccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggaaagctttctgttaccatggtttctgcagcaccagatccgaccagtgcaaactgctgtggggagagacgggaaaatccagcgacgaccaatgctacatgatgaacaccaaaggcaccagacacggaaactgtggatacgataagctgacgcagacgttttttaaatgcgaaaatgagagcgtcttgtgtggaatgctacattgcgagcatctcaatgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggcaaagggaagatgtgcgtcaaccagaaatgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 19 - DNA, 2297 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagagaacatgatattagatttgaccattaacaaagatttgattcctgaaggatttttccacaaacatcaagaaaatggagattacaaaattcatcagccaacatttcaggaagctaatatctgtgaatataatgggaaagttcgtggaaaggctaattcctgggtggccctttcgacctgcgacggcctctctggcgtaatattcgacggagaagagatgcactacgtcgaaaaaggaaattcgataggtgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttagaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacgggaaaatccagcgacgaccaatgctacatgatgaacaccaaaggcaccagacacggaaactgtggatacgataagctgacgcagacgttttttaaatgcgaaaatgagagcgtcttgtgtggaatgctacattgcgagcatctcaatgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggcaaagggaagatgtgcgtcaaccagaaatgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 20 - DNA, 4266 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagagaacatgatattagatttgaccattaacaaagatttgattcctgaaggatttttccacaaacatcaagaaaatggagattacaaaattcatcagccaacatttcaggaagctaatatctgtgaatataatgggaaagttcgtggaaaggctaattcctgggtggccctttcgacctgcgacggcctctctggcgtaatattcgacggagaagagatgcactacgtcgaaaaaggaaattcgataggtgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcaggggaccttacaatgccaacaaagaatccaaatatgtagaattagtgctcgtgatagacaatcaagaatacaaagagttgggagaaagtaaaaccaaggttgtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacggggaaatccagcgacgaccagtgctacatgatgaacaccaaaggcaccagacacggaaactgtggatacgataagctgacgcagacgttttttaaatgcgaaaatgagagcgtcttatgcggaatgttacactgtgaacatctcaacgaaaagttggaattcggcatggagtccgtagcgatgttgtcgcacactttcatcaacaaaaagggactgatcatcccttgcagaactgccattgtagatttaggaatcaatcaagtcgatccaggtcttactcctgatggtgctctttgcggaaaggggaagatgtgcgtcaaccaaaaatgcatgtcagtctcaagcttaaaaaaacaaggaccccactgccccgacgactgcaacggcaatggctggtgcaacaacaaaggccactgccactgcaaagacggcttcgctccccccacttgcgactatcccggacctggaggctcgctggacagcggtcctgcagcggatcctaatgctcgtcaaggcatagtagcagccctcttcatcattttcctaggaatagtacccctggtagcgatatctgcgttcctcctgtactacgttcgccacaacctccatttcggccggcgaaaatcaaccccatcaacgacaaaatcacccagcaaatcaagaggaccaccttttgcttcggaagttacaaaacgaacagaagacaaccattctctgctccgagaagattctccgcctccgattggatttatcggcctatcaaacaactttttcggcaattttaagggattttcgatcattccattaaaaaatgaaactcaaccaagccgatctgctcctccccctcctgttattgtgccagcaaaaagtaagtcatcggcttcatccacttcaaagcctgctaaaccggcagctactcaagaaactaaacacagcatattttcgaaccccatacagaagtataactccttcagaaagagcaacgttccaaacggtattgttactgtaaatcaagtgtctgcagcaccagctttacctccacctaatccaggaagccacgccaagccgataatttcatctccaatactagaaaattcgacctgtactgcaaaagagcttgtatcgcccttacgaaatgctccaaagcttcctattcgggcagcgcctcaagcaccttctatcgaaatcacaagaactttaaacagaataacttcttttcttaaacctgccgataaaaaacctacgattgtatcaaaacctagtcaagtaaaagctactaaagttcttgataaggagtcgctacgaaatatagagatatctaatcctattccacagaaaaacattgaaatttctgtgtctacccttcctgtggatagcgcaacaacaaaaaacgttgtgatgagggcacagagtatgcgagctactaaacagactgacagacccaacatacaaacattcggatctatgagacagccaaatggctacaagagaccacttagcatcccttcagggagccgtcctaaaaatcctccaccacctcgtccaccgttagaaaaatctcaagaaaagtcagcatctgatcagtccgatcagtacgacgattgtttaaacgaagaagtacctctagctacaggtaccaccactagtcctagtggtgataatatttacgctgttatagaagattctccggtagtatccccggaaaataaacctagcaattcaggttctagtgaaagtatgggattactaggtgagattgttaatgaaatacaaagtaggaactttgattcaatttattcaacatcaactttggctcgaaagaagaaagaagaagaggagaagaaaaaagcgcagttgtcgcctgattcttcagagacgtacgtgaatacagcttctctgcagtatccagaaagtgagtacagtaatatgagtggtaatattaagtcaagtgctagttccacttcgagtggttacattctgccatctgctattaatattccggtaaaggaagagacaaaaccaaaagaagaacctaaacctagtttaagctcttttaaagcagactcaaaacctgctgttgtaaataagcctctggcgtcggggtttaagcccagtcaagcaaatttgaaaaaagtagaaacatcaccagaaaggaagtcgaaggtactttcatctcctactagtaaaacaccgccaaagtctgtaagtaggcaaataacgccaccaaacttacgtactaggaaaccttctccgacaaggcctactgctcctgtacataaatccaaccgatcagtaaccaacagtcccgatttggtaacgagctgtaacacaaactcttcgtcgaaacctcctgacatcgttggtaccaactcggttacaaaaaaaccttccattacaagtgctaaacctacagtgcccttacctaaagttaaaagtaaccctaaggcagttaacgctaaggtgtcgcaggaaaagaaaggcgatgccaaaccagtggtagctaataaactcaacaagactagtacttcggacagtactaccaaaacttcggtaggtgttagaaacgcagctagatcgaactctaatgttgcttctttacaacaaaaattcgagaataagacgtaa

SEQ ID NO: 21 - DNA, 3921 bp, Diabrotica virgifera virgifera
atggacacggggaacaagaccactaagccccgcaaccctgcggaaaataccaatccgatttcttttctcttctttttctacatgttccctatcttcaaaaaaacgtacaagtacaaattaacagaagaagaactattttctccgttgaaggagcacacatctagtagactaggatcaaaattagaaaaagcatggaaagaagaatataggatacacaaaaagactgcactacatagggctttatttaggatatttggacttagatatacggtcttagggttaatcagattgttcgacgaactcttgttaatagttgtaatgccttactgtatacgaacgctagttgcatatttggaagcaggacagaccaaaataacgaaagatgaggcgttaatttatgcagctgcacttgtgattacacttttactagatgctgtgatgcaacaaccaaactatatgggcttacagcacatcgccatgaagatacgagtggcttgctcgtctttgatatataggaaaactttgaggtttagccgagaagctttaggaaacactactgtaggtcaattagtaaatttattatccaatgacgtaagcaaatttgaccagttatttggtttgactcattacgcctggatagggccaatccaagtcgctcttgggacgtggctattgtatagagagattggagtgagtgccttttttggtatggcgatcctagtggcgttcgtcccgcttcaaatttggttagccaaaaaaatgtctgtgatgcgtctgaaaacagctttgaggacggacgaaagggtcaaactaatgaacgagattatctccggtattcaggtgattaaaatgtattgctgggaaaaaccgttcgctcatgttattgatttggcacggagatccgaaatgcgtgcaatcagatcacactcctgcctattaggaatactatattcattcgaagtattcgtgtccagaactgctatatttgtgagcatcgtaggctacgtccttctcggtaattatgtatcagccgataaagtttttgctattaccgccatctacaaccagatgagaacaatcattaccatcatattttctctaagtataacagcattggccgagatgcacgttactatagataggatacataagctaatgatatttgacgaacgagaacaagactctgaagatggttatgaaaagatgaatggtaactatcaatctaaactgaacggactagatggcatgaagaacggtattaacggaaacggtacagctattgaattaattaaaaaagtcaaagagcctaaattgatgctatctggagtttctgccaagtggttagcacagtctcctgaaaataacctaagtgacataacattcaatgtccctcctaataaaatgctcgcgatcattggaccagttggtagcggcaagagcagcatcataaacttaatactaaaagaactaccagtaaaatcaggaaagctagaaatagatgggaaagtgtcttatgcctcccaggagccatggctttttgctgcgagcgtacgtcaaaacatcttgttcggtgaggaatatgacgaagaaagatacaaactggttgtagaagtatgtgccttaaaatcagattttgccttattcccccacggagataaaactttggttggagagaaaggaaaagctctaagtggagggcaaaaagctagagtgaatttggctagatgcgtgtacaaaaaagccgacatatatcttctagacgatcctctatcggctgttgatgctaacgtaggaaaacatctctacgatagatgcatcaaacagttcttgtcaaacaaaatatgtgttctggttacacatcagctacagtacttaagaaacgccgataagatcattatcatgaaagatggtaagatggagatgactggaagctacacagaactaaagaagagcggtctagacttcgccaaagttatggaagaatttaacgaggaagccgaagaagacaaacggatgaagtcaattaaatcaaaagcgtcaatttacgatgagccaatggaagatgaagaggaccaagttctggagaaggaaatgcaggagaagggtaccattaaggcagctacttattatttgtacttaaaagcaggcggtgggatttgttcgatgttagcactgggcttcctgtttattatttgtcaagtagttgctaatgccggagaatactatgttacttattgggtgaacttagaacaagattttagcgagaagcaaagaatgaatttaaccgcccccaatgaaactataaacagggatctgatcatgtggtcttacactgcccttatcgttggtaacataatcatatcggtagtcaaggcagtgtactttatgatttttttcgtaatagcttctaagaatctacataaatatatatttgacaaactaatcaaagcgacaatgagattttacaacacaaatccatctggaaggatcctaaacagattttcgaaggatctaggaactgtggatgaatatttgccttctgttatcattgatgttattgagattgcattacttcttcttggagctattacactatctgcaatagtagagcccttattgactgtacctgcagtggtgctaatgataattttctatttattgaaaatagtgtattctgaaaccagtagaagtgttaaaagagttgaagcaattacaaaaagtccaatgttgagtcacctcacagcttcagttaatggattgagcacagttagggctttccacgctgaaaaaatgttaacggaagaattcgacaactaccaggacagccacagtgcagcatggttcttatatttggcttccagtaaatgttttggactttggttagatataatctgtattgtcttcatagctgtggcagtattttcgctcttgttgttccgagacacaatccatggaggtgatttaggtttagtcatcactcagtatctgggtctaatgggctcactccagtggggaatgcgacaatggaccgaactagaaaacaacatgacgtcagtagaaagaattttggaatacacccgtttggaaacagaacctgaacggaaagaacctaaaaatattcctcagccgtggccggagaagggtcttgttgaattcagagacgtcagtttgcgatacagtccacaggatccgcctgtacttaagggactgaactttacagtacagcccaaggagaaaattggcatagttggaaggactggggctggtaaatcgtcaaccataacggctctctttcaactctatccacttgaaggaactgttgtggtcgatggtgtagatacgacgcaaataccgttggatttggttaggactaatatttcgattataccacaagaaccagtgcttttctcaggtaaaatgcgtgaaaacttggatcctttcgaaaattacagcgatgacgtattatggaacgccttagatcaagttgaactgaaagatgtaatatccgaactgccagcaggcctcaatacagaagtcacagaaggaggaaataacttcagtgttggccagaggcagttggtttgtctggcgagagctcttattagaaataataaaattttggtcatggacgaagctaccgcgaatgtggatccacataccgattctttgattcagaaaaccataagggataagtttgcggattgtacggtgctgacaattgcccacaggctacatacggtaatggattctgacaaaatattggttatgaattccggcagagtggaggaatttaatcatccatatcttcttctacaaaacgtacatggtgtgcttcacaatttggttgacgctactgggccttctactgcaaagaatttagaaaacatagccaaagagagttacgagaagaaaagagtttaa

SEQ ID NO: 22 - DNA, 2805 bp, Diabrotica virgifera virgifera
atgtgggtaatacttctcttatccatacttgcttcagcaacggcttcaaatccagatctggcttcttcagatacagatccagatctatttcccgtacaaagagcgactgaagaagcagaaatctccagtaacaagtacttgttatcatcaccagttattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttatacactggaaataataacactcagtggtacataccggttacttacagattgtcaaatagctcttcatatgaaacattttggttggcacccaatagttctgtaacaatactaaataatttaactgacaaagactggttaattgtaaatgatgattctagaggttattacagagttaagtattgcaaaaggctaacgcaaagaatacaatctctattaaatcaaaatcacactcaaatttcggagttaaacagagctcaaatactagacgactctcttaatcttgctagggctggatacattaaatactccgaagctttcgagcttctggaatatttaaaaaatgaaactagctacttcccttggttcactacgattaaaaatatggattatttagtaacaagattaggagccaataccgagttgggaaaaagaacaaatgctatgatattagaccttataagtcagatttcagccaacatttcaactactaaatgggaagaaattgatcaagttactactttgaaattgcaaagggtgtgggcagatgcttgtaaaagaggccaggcaagttgtatttctgagacaaagagactgtttcaggcattaagattaaacaaaactagcgtaaatccaaatataagagacgtagtatactgtaatgccttgagaaatagtaacaatattgccgctgattgggagttcctgtggaacagactattgatctctattcatcctcaggaagatctttacatattactgagtttgggatgcacaacacacaagccctacttaacaagattattggatgcaaccataaactctacatcagtaataaaacttcaaaacctatataccgtatggaattcagttggttctgccagtaaagaaggtttagatcttgcttttgaatatttcgttaacaactacaaaaaaattattgaatattatcccgatggtatatcattattatctcaattggccaacagatttacaactaatgctgaggtcacaaagttgcaacaattcgctgatcggctggagaagaactcaacaatcagagctgttgcaaattcagctttaactacagcaagacagaatttacaatttagggctcgaattgaagatgacctgaacgattacttcaagattgataactccgggtcatcagtaactcctcttggaatatttatgcctttattattgttaagtgtagttttctttatgtaa

SEQ ID NO: 23 - protein, 565 aa, Trichoplusia ni
MRSIVTLLVLVAACGALADRYHPAEPAERAGPAGRASPAELLGSHWRAQAQDALKERLARPANRNKARNVIMFLGDGMSVPTLAAARALLGQRQGATGEEAQMTFESFPTSGLSKTYCVNSQVADSACSATAYLCGVKTNQGLLGVDASVQRHNCESSIDTARHVESIAEWALADGRDAGIVTTTRITHASPAGVFAKTANRNWENDAEVKAANQDINACPDIAYQLIHKHPGNKFKVILGGGRRNFLPTTVTDEESQAGRRTDGRNLIEEWQQDKAARGVSFKYVWNVSELLQLNDNLPEYLLGLFESNHLQYHMQANLNTEPTLEQLTETAIRMLNRNEKGFFLFVEGGRIDHAHHDNLAHLALDETLEMDKAIKRAVDLLSEEDTLIVVTADHAHVMSYNGYSRRGNSILGPSRDTDENNVPYMTLSYTNGPGFRPHVNGKRSDVTQENGFGTLTWKSHVDVPLDSETHGGDDVAVFARGPYHMLFTGLYEQNQIPHLMAYAACIGPGLHSCAEADTTSTPEANPSEATTASPTTAEPSAAAPVSATLALFALLTTLTLLLH

SEQ ID NO: 24 - protein, 982 aa, Trichoplusia ni
MANRFTLLLLGVALAQGILAYSPIEMPEDEWQEYRNLMRDPTYRLVRTTEPETYKVTLTPYFDTNDAKAFTFDGEVEILIKANQAVSEIVLHCNDLTISKLTVTTETSTTDLAEAGQTFTCEANTSFLRIKTTSPLEAEAKYVIKSEFTGNLQTNMRGFYRSWYVDSSGNKRWMATTQFQPGHARQAFPCYDEPSFKALFDITIKRLPDFSETLSNMPIKTRGPLTDGRIAETFHTTPKTSTYLLAFIVSHYKEVATGTDLNRPFKIYARDNAKLTGDWSLDIGERLLEEMEKITDVPYYGMALNMDMKQAAIPDFSAGAMENWGLLTYREALILYDPKHSNHFYKQRVANIVSHEIAHMWFGNYVTCAWWDNLWLNEGFARFYQYYLTDRVDKNLGFDTRFIVEQLHTSLLSDSGVNAHPLTDENVSSPTTVSAHFSTITYAKGASVLRMTQHLLGNSTFEKGLRSYLKARRYDVATPDDLFDALQEAATLDGALTQYPGATVKAYFETWTSKAGHPLLTVTVGNDGTMKVTQERFGLTPVTTFEGTWQIPITWTSQGNVDFYDLKPSRILTGTSTTIDVGTDQRGWLIFNKQQTGFYRVDYDPITWAHNTMALRNAEVRKDIHVYNRAQIVDDVFLLARSERMTYRQAFNILSFLEFEDEYAPWIAAIAGFNFAVRRLAHDEAALAKLQAHIHSTAAAVVNRLGYEDKGGDDNFMDDLLRMNLMQFLCNVNHEKCIEEGVKSFQSWKANEAFHIPANHRPWVYCAGLRAGDASDFDVFWSRYLKEDLASEKVVMVTAAGCTGDEASLRKFLNAIVDDKEDIRPQDYSVALNSAIASNEVNTLRAFEWLKTNVDQTVKTLGSINSPLSTISSRLLNDAQINTVETWLNENAEIIGASAVAAGRSGIATSKSNIEWLTKRKVEFEDYFETGFEDPLAPPVTETEASTSSPTAAPSTTEAPASASTAALSVVAMLVTLAVNMV

SEQ ID NO: 25 - protein, 940 aa, Trichoplusia ni
MSQTLLWALGLALLAVAKADNPISYYIESQDFPFDEIPEDTISRNDQRVYRLPTSVVPVEYDIHINLFFAERTEKPFSYEGFETIIVEAKEEVNEIVLHANVDRIQSISVFDSTGRPLRLQRFNPFHTEKVYHFLKINLAETLAVGAKYTLHINYEGTMNVGPMKRGIWRGWYVDSNNVERIYATTHFQPYNARQAFPCWDEPYFKAIFKLHLSSPSGYTGTFSNTAIEQTVSLPNNRVRVDFAPTPKMSSYLVTFLVSESFQVIAQDTSFDPPIRIIGRSNTNGLADHALDLAVKMTKYFDSYFEIPYSSLSPNLLNDHISSPDWASAGTENWGMVSYRELYLILSEEETLMSVEHYAATLVSHELAHKWFGNLITCHWWSNTWINEGYASYFGYIATHEMFPKYEFPDHFNTRYLQTSLSFDSGVSTVPLNHDVNTPAQVTGHFGTISYSKAAAFLRMTANIMSPETFRKSCKLFLQSNAYSPTDPDDLLKSMLEAIEEDNSLADYGSFSFADYYNIWVNEPGYPILNVTVNHTTGVISLSQERFFLSSSAAPTGQIYPIPITFSTKTNPSFSILKPSHIMTGATLTINKAAVEEWVIFNNMQHGHYRVNYDSKTWSLIAEALLEEPSPIHILNRAQIVDDVFALMRSNRMTHNDGFKILKFLAKETSIHIWSPAISGFTWLRNRLRHLPAKQAEFDAFLLSQMEHAINELGYEPKPNETPTITMARQDILQFACTLGHEKCNQDSWERFVNLRDNGVPINARIRRNVYMTAMRKGNQRDFEYLLNRFRSSNYANDQLEMLRGMGASTDPELLTRYLALTLQKAVRTHDKLNSFNYALLGNNENVKTVVMFVKHNIDQIRTAYVEDSPANPVHSALSNIAAYLDEDGLDDYEHWLRTTQSGIPQFNSAISGINSARNNIAWGTANADVILAAARGSAA

SEQ ID NO: 26 - protein, 1733 aa, Trichoplusia ni
MEADVRITTAALLLFAASFVNAQNDGLRCTYMKEIPRGETPVFEIKDFDGVPWNQQPLIPLPQREELCIEDPAFAGNSIVMTIFMEEEIEGEIAIAKLNYKGTETPSIRQPFASGSFHMLGPVIRRIPEDGGDWHLVITNKQDYEAPDMQRYSFDISVPSESAVLIVMLDIINIDDNAPIIHMIDRCEIPEPGELGRTSCVYTVTDADGRLSTEFMTYEIESDRDDADYFELVNDHTIDPDDKTTHMVLYLHKALDFELNPLHIFRVTALDSKPNTHTVTMMVQVLNVDRRNPRWLDIFAVQQFDEKTVQRFHIRAIDGDTGLDREIYYKLEADEEDTFFSLEPIAGDRSGATLVVDKIDRDTLQREVFQLSIVAYKYGIDDKEGKNPFETRANIVIIVNDVNDQRPLPFKNTYTIEIDEETPMTLNLEDFGFHDIDLGENAQYEVFLESVYPEGAEEAFMISPTRGYQEQSFIVSTRNHHLLDYEVEKYQNIQLKVKAIDLNDTRLTGEALLNINLRNWNDELPIFEHSAQTVDFDETVGKDFPVAIVKADDRDIGDKVVHSLLGNAEDYLTIDPDTGEISVAHDDYFDFHRQNEFFVQVRATDTLMEPYNSVTAQLTIRLRNINNTPPTLLLPRGSPEVEENVPQDFVIPAEIAATDPDLDAQLEFEIDWESSYATKQGRPAPDVEFHKCVEIITIPTETRHRVIGRLDVRTIREGVTIDYEEFEILYLSIKVYDRNTVAGAIDHAESILAINIIDMNDNPPVWAAGQLRQALRVREGSPAGGIIGSLLATDIDGPLYNKVRYSIHPKPGTKEGLVAIDPILGQLTVLGDGEIDADVPKTWTLEYTVIASDRCVEDDGVACTGTDPTVWNTEGDLSIDIIDTNNKNPETASPSITVWVWENATHGDPVAQLSATDLDRDELYHTVRYQILYSVNPMLLELFAVNQDSGLITVHYTTDTVLDRDGDYPEHTIFLNLFDNFFFDGDGQRNMAEKRVLVVLLDVNDNAPELPLPEELSWSVSEDEREEVRVLPHIYAPDRDEPDTDNSRVGYAILGLKVTNREIEVPELFNMIQIENKTGELETARHLKGFWGTYSIHIQAYDHGIPQQISEETYTLTIRPYNYHEPVFVFPQAGNTFRLSREQSTVNGVLVRVDGQSFPRVSATDGDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVGSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNMNPLDTMVGMFEFDVVATDTRGAEARTDVKIYLITHLNRVYFLFNNTLDVVDSNRAFIADTFSSVFSLTCNIDAVLRAPDSSGAARDDRTEVRAHFIRDHVPATTEEIEQLRSNTILLRAIQETLLTRELHLEDFVGGSSPELGVDNSLTIYVLGALAALLGFLCVLLLITFIVRTRALNRRLEALSMTKYGSVDSGLNRVGLAAPGTNKHAVEGSNPIWNETIKAPDFDAISDVSNDSDLIGIEDLPQFRNDYFPPADDSSLRGIVLDNQNNDTVATHGNNFKFNASPFSPEFGNTPIRR

SEQ ID NO: 27 - protein, 1733 aa, Trichoplusia ni
MEADVRITTAALLLFAASFVNAQNDGLRCTYMKEIPRGETPVFEIKDFDGVPWNQQPLIPLPQREELCIEDPAFAGNSIVMTIFMEEEIEGEIAIAKLNYKGTETPSIRQPFASGSFHMLGPVIRRIPEDGGDWHLVITNKQDYEAPDMQRYSFDISVPSESAVLIVMLDIINIDDNAPIIHMIDRCEIPEPGELGRTSCVYTVTDADGRLSTEFMTYEIESDRDDAVYFELVNDHTLDPDDKTTHMVLYLHKALDFELNPLHIFRVTALDSKPNTHTVTMMVQVLNVDRRNPRWLDIFAVQQFDEKTVQRFHIRAIDGDTGLDREIYYKLEADEEDTFFSLEPIAGDRSGATLVVDKIDRDTLQREVFQLSIVAYKYGIDDKEGKNPFETRANIVIIVNDVNDQRPLPFKNTYTIEIDEETPMTLNLEDFGFHDIDLGENAQYEVFLESVYPEGAEEAFMISPTRGYQEQSFIVSTRNHHLLDYEVEKYQNIQLKVRAIDLNDTRLTGEALLNINLRNWNDELPIFEHSAQTVDFDETVGKDFPVAIVKADDRDIGDKVVHSLLGNAEDYLKIDPDTGEISVAHDDYFDFHRQNEFFVQVRATDTLMEPYNSVTAQLTIRLRNINNTPPTLLLPRGSPEVEENVPQDFVIPAEIAATDPDLDAQLEFEIDWESSYATKQGRPAPDVEFHKCVEIITIPTETRHRVIGRLDVRTIREGVTIDYEEFEILYLSIKVYDRNTVAGAIDHAESILAINIIDMNDNPPVWAAGQLRQALRVREGSPAGGIIGSLLATDIDGPLYNKVRYSIHPKPGTKEGLVAIDPILGQLTVLGDGEIDADVPKTWTLEYTVIASDRCVEDDGVACTGTDPTVWNTEGDLSIDIIDTNNKNPETASPSITVWVWENATHGDPVAQLSATDLDRDELYHTVRYQILYSVNPMLLELFAVDQDSGLITVHYTTDTVLDRDGDYPEHTIFLNLFDNFFFDGDGQRNMAEKRVLVVLLDVNDNAPELPLPEELSWSVSEDEREEVRVLPHIYAPDRDEPDTDNSRVGYAILGLKVTNREIEVPELFNMIQIENKTGELETARHLKGFWGTYSIHIQAYDHGIPQQISEETYTLTIRPYNYHEPVFVFPQAGNTFRLSREQSTVNGVLVRVDGQSFPRVSATDGDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVGSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNMNPLDTMVGMFEFDVVATDTRGAEARTDVKIYLITHLNRVYFLFNNTLDVVDSNRAFIADTFSSVFSLTCNIDAVLRAPDSSGAARDDRTEVRAHFIRDHVPATTEEIEQLRSNTILLRAIQETLLTRELHLEDFVGGSSPELGVDNSLTIYVLGALAALLGFLCVLLLITFIVRTRALNRRLEALSMTKYGSVDSGLNRVGLAAPGTNKHAVEGSNPIWNETIKAPDFDAISDVSNDSDLIGIEDLPQFRNDYFPPADDSSLRGIVLDNQNNDTVATHGNNFKFNASPFSPEFGNTPIRR

SEQ ID NO: 28 - protein, 450 aa, Trichoplusia ni
AGNTFRLSREQSTVNGVLVRVDGQSFPRVSATDEDGLHAGSVSFSVVGAAAEYFSMRNFEDNTGELYLSQPLPLEDDGFDITIRGSDAGTEPGSLFSEVSFRLVFVPTHGDPVFSVSQYTVAFIEKEAGLLESHQLPRAVDPKNYMCEEMNEPCHEIYYSIIDNNEEGYFQVDSTTNVISLSRELERASQASHVVRVAASNTLLDPAAPPPLLPSSTFLLTINVREADPRPVFEREIYTAGIYETDTSNRELLTVHATHTEGLDITYTMDLDTMVVDPSLEGVRESAFTLHPSSGVLSLNFNPSATMVGMFEFDVVATDTRGAEARTDVKIYLITHLNRVYFLFNNTLDVVDSNRAFIADTFSSVFSLTCNIDAVLRAPDSSGAARDDRTEVRAHFIRNHVPATTDEIEQLRSNTILLRAIQETLLTRELHLEDFVGGSSPELGVDNSLT

SEQ ID NO: 29 - protein, 982 aa, Pseudoplusia includens
MANRFTFLLLGVALAQGILAYSPIDLPEDEWLEYRNLMRDSNYRLPRTTEPETYKVTLTPYLEASDGVKQFTFDGQVEILIVAKEAVSEILLHCNDLQISVLTVSAQSADANLVEPGQTFNCEDNTSFLRIKTASPLVANSKYVIKSTFTGNLQTNMRGFYRSWYYDNSNTKKWMATTQFQPGHARQAFPCYDEPSFKARFDITIIRPTTFSDTLSNMPIKEKGTEVNGRIPETFHTTPKTSTYLLAFIVSHYVPVSTGTTPNRPFVIYARNNAGTTGDWSLDVGERLLDEMEKYTGIEYYKMADYMNMKQAAIPDFSAGAMENWGLLTYREALILYDPRHSNHFYRQRVANIVSHEVAHMWFGNLVTCAWWDNLWLNEGFARFYQYYLTHRVEPKLGYDTRFIVEQLHTSLLSDSSANAHPLTDESVSSPTTVSAHFSTITYAKGASVLRMTQYLLGVETYEKGLRKYLEDHKYDVATPDDLFNALQNAATDDAALSQYAGATVKEYFESWTQKPGHPLLTVAVNNDGTMQITQERFGLTPSTATQGLWHIPISWTRQGEVDFDNLKPSQILTATSIQVDVGTTERGWLIFNKQQTGFYRVNYDPTTWAHNTMALRNSEERAKIHEFNRAQIVDDVFLLARSERMNYRVAFNILSFLEFEDAYAPWIAAIAGFNFALRRFAHDEVALAKLQSHIHTAATAVVNRLGFEDKGGDDNYMDDLLRMYVMQFLCNAKHEKCVEEGVKLFQSWKADPQFHIPANHRPWVYCAGLRAGDASDFDVFWARYLAETLASEKVVMVTAAGCTGNEASLRKFLDSIVDDEEDIRPQDYSVALNSAITGNEVNTLRAFEWLKDNIGQTAKTLGSINSPLSTISSRLLNEEQINTVDTWLTAQATVIGTSAVNAGRAGIETSRNNIEWLNKRKSEFEEYFESGFDDPLVTPPAETTTPASTSAPTTTEAPASAHTAALSVVTLLVTLAVNMIN

SEQ ID NO: 30 - protein, 1733 aa, Pseudoplusia includens; identical to SEQ ID NO: 27

SEQ ID NO: 31 - protein, 1773 aa, Pseudoplusia includens
MEVDVRITTAALLIFAATLVSAQTNQLRCTYIQEIPRGDTPVFNFPSFDGVPWSQQPLLPLPQREELCMEDPVSAGSSVIMTIYMEEEIEEEIAIAKLNYKGTGTPEIGPAFTTGSFHTLGPVFRRIPEDGEWHLVITNKQDFEAPNMQRYWFDISVPGESVGLMVLLEIVNIDDNAPIVHMIDRCEIPEPGTHGRTACAYTVSDADGRISTEFMTYKIDSDRNDQDFFELVNDHTMDADEKITHMVLYLHKDLDFEVNPLHIFSVTAFDSKPNEHEVTMMVQVQNTDRRNPRWLDIFAVQQFNEKTTQRFPIRAIDGDTGIDRQIHYRLEADEEDTFFSLELAADGNGAVLVVDEIDRDTLMREVFQLSIVAYKYGPNDEEDRPSFETRANIVIIVIDVNDQRPIPFKQIDDDNNNDDGDDSSDDDEDSSADSSRNELAPEVPEDPTIRIYKITIEEETPMTLNLQDFGFHDRDLGENAQYEVHLESISPEGAEEAFSISPTRGYQDQSFIVSTRNHRLLDFEVEEFQKIRLRVIAIDLNDTSLRGEAWLHIDLENWNDEMPIFGQDVYTAEFDETVGEGFPVATVRATDRDIGDRVVHSLLGNAGDYLTIDPDTGEIFVAHDNYFDFHRQNEYFVQVRATDTLLDTNNTATAQLTIKLRNINNTPPTLLLPRFSPEVKENVPEDFVIPADIEATDPDLDAQLEFEIDWEQSYATKQGRPTPAIEFHNCLEIITVPTESRHRVVGRLDVREIRTGVTIDYEEFEILYLSIRVIDRNTVPGAIDYAESILAINIIDMNDNWPIWAAGQLQQSLRVREGSAAGVVIGSLLATDIDGPLYNKVRYSLVPIGETKPDLVTIDPIFGQLTVLTGGQIDADEPKTWALEYTVTASDRCVEDDGFPCTGDDPTVWNTEGYLCIDIIDTNNKSPETENANITVWVWENATEGDTVAQLSATDLDRDELYHTVRYQILYSVNLRLLNFFAVDLDTGLITVHYPTNEVLDRDGDEPEHTIFLNLFDNFYFDGDGQRNMAEKTVRVRLLDVNDNAPELPPPDELSWTVSEDEPAESRVLPEIYAPDRDEPDTDNSRVGYAILGLEVNRDIEVPELFTMVQIENVTGELETAMHLKGFWGTYTIHIQAYDHGIPQQVSEERYSLVVRPYNYHAPEFVFPQQGAVYRLSLEQSTVNGVLVQVSGQSFPRVTATDEDGLHAGAVTFSVVGAPGEYFSMRNFDDNTGELYLTQPLVNTELDITIRGTDGGTEPDSKFSELSFRLVFVTTLGDPTFAVEEHTVAFIEKEAGLLESFQLPTAVDAKNYLCEELNEPCHQIYYNFIEGNSQGYFQVEPTTNMISLTRELDRAVEARYVLRVGTSNAPIDPSAPPTLMAASTLLLTVNVREADPRPLFQRDIYSAGIYETDVTGKLLLTVHATHTEGLDITYSMDMETMEVDLSLEAVKDSALILHPTEGSLTLNMNPLENMVGMFEFDVVATDTAGATARTDVKIYLITHLNRVFFTFNNTLDVVDANREFIADTFSLGFSLPGFRLTCNIDAVLRATDSNGIARDDRTEVRAHFIRNNIPATTEEIEELRSNTLLINSIQETLFTRSLSLEDFVGGASPELEADNNLTVYVLSALTAMLGLLCLLLLVTFIIRTRALNRRLEALSMTKYGSVDSGLNRAGLAAPGTNKHAIEGSNPIWNETIKAPDFDAISDVSNDSDLIGIEDLPQFRSDYFPPGDDHSLQGIVLDNQNNDTVATHGNNFKFNASPFSPEFGNTPIRR

SEQ ID NO: 32 - protein, 1773 aa, Pseudoplusia includens
MEVDVRITTAALLIFAATLVSAQTNQLRCTYIQEIPRGDTPVFNFPSFDGVPWSQQPLLPLPQREELCMEDPVSAGSSVIMTIYMEEEIEEEIAIAKLNYKGTGTPEIGPAFTTGSFHTLGPVFRRIPEDGEWHLVITNKQDFEAPNMQRYWFDISVPGESVGLMVLLEIVNIDDNAPIVHMIDRCEIPEPGTHGRTACAYTVSDADGRISTEFMTYKIDSDRNDQDFFELVNDHTMDADEKITHMVLYLHKDLDFEVNPLHIFSVTAFDSKPNEHEVTMMVQVQNTDRRNPRWLDIFAVQQFNEKTTQRFPIRAIDGDTGIDRQIHYRLEADEEDTFFSLELAADGNGAVLVVDEIDRDTLMREVFQLSIVAYKYGPNDEEDRPSFETRANIVIIVIDVNDQRPIPFKQIDDDNNNDDGDDSSDDDEDSSADSSRNELAPEVPEDPTIRIYKITIEEETPMTLNLQDFGFHDRDLGENAQYEVHLESISPEGAEEAFSISPTRGYQDQSFIVSTRNHRLLDFEVEEFQKIRLRVIAIDLNDTSLRGEAWLHIDLENWNDEMPIFGQDVYTAEFDETVGEGFPVATVRATDRDIGDRVVHSLLGNAGDYLTIDPDTGEIFVAHDNYFDFHRQNEYFVQVRATDTLLDTNNTATAQLTIKLRNINNTPPTLLLPRFSPEVKENVPEDFVIPADIEATDPDLDAQLEFEIDWEQSYATKQGRPTPAIEFHNCLEIITVPTESRHRVVGRLDVREIRTGVTIDYEEFEILYLSIRVIDRNTVPGAIDYAESILAINIIDMNDNWPIWAAGQLQQSLRVREGSAAGVVIGSLLATDIDGPLYNKVRYSLVPIGETKPDLVTIDPIFGQLTVLTGGQIDADEPKTWALEYTVTASDRCVEDDGFPCTGDDPTVWNTEGYLCIDIIDTNNKSPETENANITVWVWENATEGDTVAQLSATDLDRDELYHTVRYQILYSVNLRLLNFFAVDLDTGLITVHYPTNEVLDRDGDEPEHTIFLNLFDNFYFDGDGQRNMAEKTVRVRLLDVNDNAPELPPPDELSWTVSEDEPAESRVLPEIYAPDRDEPDTDNSRVGYAILGLEVNRDIEVPELFTMVQIENVTGELETAMHLKGFWGTYTIHIQAYDHGIPQQVSEERYSLVVRPYNYHAPEFVFPQQGAVYRLSLEQSTVNGVLVQVSGQSFPRVTATDEDGLHAGAVTFSVVGAPGEYFSMRNFDDNTGELYLTQPLVNTELDITIRGTDGGTEPDSKFSELSFRLVFVTTLGDPTFAVEEHTVAFIEKEAGLLESFQLPTAVDAKNYLCEELNEPCHQIYYNFIEGNSQGYFQVEPTTNMISLTRELDRAVEARYVLRVGTSNAPIDPSAPPTLMAASTLLLTVNVREADPRPLFQRDIYSAGIYETDVTGKLLLTVHATHTEGLDITYSMDMETMEVDLSLEAVKDSALILHPTEGSLTLNFNPTANMVGMFEFDVVATDTAGATARTDVKIYLITHLNRVFFTFNNTLDVVDANREFIADTFSLGFSLPGFRLTCNIDAVLRATDSNGIARDDRTEVRAHFIRNNIPATTEEIEELRSNTLLINSIQETLFTRSLSLEDFVGGASPELEADNNLTVYVLSALTAMLGLLCLLLLVTFIIRTRALNRRLEALSMTKYGSVDSGLNRAGLAAPGTNKHAIEGSNPIWNETIKAPDFDAISDVSNDSDLIGIEDLPQFRSDYFPPGDDHSLQGIVLDNQNNDTVATHGNNFKFNASPFSPEFGNTPIRR

SEQ ID NO: 33 - protein, 1014 aa, Helicoverpa zea
MANRWYTLLLGAALLQSVLSFGPIEVTDDEWAEYRNLMRDPAYRLPTTTKPSNYAVNLTPYFTGTTLAFTFEGSVRITITATQANVNEIVLHCNDLTIESVMVATEASPNVNLIASGQTFVCDPVYSFLRIRTASALNINTNYIITSNFRGNLQTNMRGFYRSWYVDSSGTKRWMATTQFQPGHARQAFPCYDEPGFKATFDITINREADFSPTLSNMPIRTTTPLATGRVAETFHTTPETSTYLIAFIVSHYSQVASNNNQQRPFHIYARDNVGVHGNFALEIGVPLLEVMERYTEIPYYGMAQNMNMKQAAIPDFSAGAMENWGLLTYREALILFDPVNTNNFYRQRIANIISHEIAHMWFGNLVTCAWWDNLWLNEGFARFYQYYLTGVVAPEMGFETRFIVEQLHVSMLSDSLDSAHALTNPNVNDPTTVSAHFSTITYAKGASIIRMTQHLLGNNTFVKGLRTYLKDNAYGVAEPRHLFTALDAAATADNALANYGGMTIDRYFRSWSEKAGHPLLTVSIDHSSGRMTIIQTRFERNTGVSTATDSLWDIPITWTRAGSIDFDNLKPTQFISGVLTIIDRGTIGREWVIFNKQQTGFYRVNYDQITWGLITQALRSNVRLSIHEYNRAQIVDDVMLLARAGIMTYSRALNILSFLKFEDQYAPWGAAITGFNFALRRLAHDVTAHQKLRNEILDLSTAIVNRLGFSEPAVSNFMDDLLRMNVMTFLCDIGHQGCITAARTSFATWKNGGVVPPNMRPWVYCNGVRYGDQSDFTHLWNRYTASDVANDKLVMLSAAGCTLNQASLNIFLNAIVSGGDDIRPQDHSAAIAAAVRSNEVNTMRVFTWLQANVQQTINTLGSVSPILNEITARLLNEAQITQVQTWLNANQNLIGTAAHTSATNGIATSRSNIQWYTQRVPEFNVYFETGYVEENFADTTTTSTTTTTTTTTTTTAAPTTTTTTEAPTTTTTTTTGAPTTTTTEATTTPVPGSANIATLSIVTMIVTLVVNMA

SEQ ID NO: 34 - protein, 535 aa, Helicoverpa zea
MVTLFPYVVAVLCGATSVRAYWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGKRAFLPNTEQDEKRSYGRRIDNRNLIKEWEDDKVSRNVSHQYVWHREQLMRLKEDLPEYMLGLFESSHMTYHLKSDPQSEPTLAELTEVAIRSLRRNEKGFFLFVEGGRIDHAHHDNLVELALDETLEMDKAVATATEMLSEDDSLIVVTADHAHVMTFNGYSNRGHNILGPSRDVGLDNVPYMTLTYANGPGFRPHVNNIRPDVTLEPNYRTLDWESHVDVPLVDETHGGDDVAVFARGPHHSMFTGLYEQSQLPHLMAYAACIGPGRHACASAAHLPSAHFFVALLALFTSILLR

SEQ ID NO: 35 - protein, 535 aa, Helicoverpa zea
MVTLFPYVVAVLCGATSARAHWLHPAAPAAASRAETSANYWAQDAQAAINARLERVESVKKARNVIMFLGDGMSVPTLAAARTLLGQRQGKTGEETKLHFETFPTIGLVKTYCVDAQIADSACTATAYLCGVKNNYGAIGVDGTVRRGDCQAASNTATHVESIAEWALADGRDVGIVTTTRITHASPAGTFAKTANRTWENDGEVSQMGLDAKDCPDIAHQLVHHHPGNKFKVIFGGGRRAFLPNTVQDDEGSYGRRIDNRDLIQEWKNDKDSRNVSHQYLWQREQLMNLNDDLPEYMLGLFESSHMEYHLKSDPQTEPTLAELTEVAIRSLRRNEKGFFLFVEGGRIDHAHHDNLVELALDETLEMDKAVATATKMLSEDDSLIVVTADHAHVMTINGYSGRGNDILGPSRDVGRDRMPYMTLSYTNGPGFRPHVNDIRQNVTAEPNYRTLDWESHVDVPLVDETHGGDDVAVFARGPHHSMFTGLYEQSQLPHLMAYAACIGPGRHACASAAHLPSAHFFVALLALFISILLR

SEQ ID NO: 36 - protein, 1013 aa, Helicoverpa zea
MAAIKLLVLSLACACVIAHSPIPPVSRTIFLDERLEGGAFENIDAFKNIELSNAAASPYRLPNTTFPTHYKVLWVINLSDNEQTYSGTVDITLQATQPNVNEIVIHCDHLTVTSVVLRQGTATEGTLIPTTPTPQSQYHFLRVALNDGVLLYNENVPVQYTLSIAFNAEMRDDMYGIYRSWYRNLPTDNNIRWMATTQFQATAARYALPCYDEPGYKAKFDVTIRRPLGYKSWFCTRQRITRPSTTGYAEDEYHTTPEMSTYLLALIVADYDSLATLDANDRVLHEVIARPGAIINGQAAYAQRAGQDLLGNMSDHTGFDFYKQDENLKMTQAAIPDFGAGAMENWGLLTYREAYILYDEQHTSSNFKQIIAYILSHEIAHMWFGNLVTNAWWDVLWLNEGFARYYQYFLTAWVEDMGLATRFINEQVHASLLSDSSIYAHPLTNPGVGSPAAVSAMFSTITYNKGASVIRMTEHLLGFEVHRAGLRKYLEDMKFKTVQPIDLFTALETAGNDAGALDAYGDHFDFVKYYESWTEQPGHPVLNVHINHQTGHMTIYQRRFDIDTGYSVQNRNYIVPITFTTGADPDFSNTKPSHVISKAVTVIDRGVVGDVWTIFNIQQTGFYRVNYDDYTWDLIILALRGADREKIHEYNRAQIVNDVFQFARSGLMTYERALNILSYLENETDYAPWVAAITGFNWLRNRLVGKPQLAELNAKIVQWSSKVMSELTYMPIEGEPFMRSYLRWQLAPVMCNLNVPACRAGARVIFDNLRLYQHEVPVDSRSWVYCNALRDGGAVEFDHLYNRFKAHNVYTEKILILQTLGCTSHPASLTTLLNDIVTPNNIIRPQDYTTAFSTAVSGNEENTLFVLNYIQNNLETVLKAFTSPRTPLSYIAARLRTVEDVTAYQTWLNLTTTREVLGTSYNNIYGDSVAAYNSILWVATVEDSLSAYLTNGDNVIQPTTSTTTTTVAPTTVTQPPITEPSTPSLPVPVTDGAMTSFASLFIISLGAILHLIL

SEQ ID NO: 37 - protein, 1359 aa, Spodoptera frugiperda
MDTKKGSKNDSKSKPPPPKPKSVPNVFKRTFFCWMLPIFYFGNRRDLEESDLPPPKNMYQSKMLGDKLERSWLKEEHEAKLAGRKPKFTKVLFKTFIWSYIPGGLMQATSIGLRTASPLLFSQLLRYWAADSPVDRETAMYYAISMILANWASSFMNHHGVLFCQQFGMKLRCAVGSLMFRKIMRMSNGSLGDTAAGKVVNILSNDLQRFDLSMVFLHYVWIIPLQIAAVIYLGYLQAGTAAFIGFAALIIIALPFQGGLGQYLGKIRLRTAEKTDNRIKIMSEVINGIQVIKMYAWEIPFQKVVGQKRAEELKEVKIATILRTVFLGFMMFTERAALFFTVLTYVLLGNVMSANVFYPLQQFMSAAQVNITLILPMVLSFTAELFVSLGRVEKFLLLEDRPDLKGHPEETSSNLFRNMSADGIPETNGSIRPLSYHRKSEASPIEPGSEIQLKVPKFTRSVSYQEDSALVLHDVSASWTGDPNMMALKNISMRLRKGKLCAIIGAVGSGKSSILQLLLKELPSATGTISIYGKMSYACQEAWLFPSTVRENILFGLPFEPGKYKKVCRVCALEKDFKQFPYGDQTLVGERGVSLSGGQRARINLARAVYREADIYLLDDPLSAVDANVGRQLFEGCINGYLRGRTRILVTHQIHFLKAADYIVVLNEGRIENMGTFDELVSSGKEFAMMLAQLQEGKEKDTESVGSRSIEEKEKPALKTMISVNEGEEVQEFEAQKMKEEERQSGNLRWEVISAYFRSGGHVCFILFALLVVVLATTCAASVDYWVSYWTNQMAAYEESLGGESIEPGLDVQAGRFTVGQYLTIHGCLVAALVLMVNLRVFPFAYLCVSASAKLHNQMFSTMLRGVMRFFDTSSSGRILNRFTKDMGSLDEILPRTLLDVLQIYGTLTAILVLNAIALYWTLVPSAVLLVLFGFMVRIYLKAAQGIKRLEGTTKSPMFGTVTSSLSGISTIRASNAQERLIEQFDINQDLHTTSWNSYLNGGTTFGFYLDTMCLVYMTTIIFVFLFIDFGDAIPVGSVGLAVTQSNTLTLMLQHGARMLVEFLAQLTSVERILEYTRIDTEPDLFQGKVEMPPNWPYQGRIEFQNVSLRYAPNEQPVLKNLNIVIESGNKIGIVGRTGAGKSSLISALFRFAYLDGLISIDGLDTSLISRQGLRSKISIIPQEPILFSATIRYNLDPFDIYSDDDLWRALEQVDLKSAVPSLDFKVTEGGSNFSVGQRQLMCLARAVLRSNQILIMDEATANVDPQTDNFIQETIRRQFVSCTVLTIAHRLNTIMDSDKVLVMSSGQVAEYDHPYVLLSDPNSHFSAMVRETGEKNSANLFQVAKDAYFQSNLKENAR

SEQ ID NO: 38 - protein, 541 aa, Spodoptera frugiperda
MRSLLTYLVAAVVVAACVRGDRYHPADPGSRADTVVNRAETSANYWAQEAQAAINARLAHKESVKKARNVVMFLGDGMSVPTLAAARTLLGQRRGHTGEEDKLHFETFPTVGLTKTYCVNAQIPDSACTATAYLCGVKTTYGAIGVNAEVPRKGCEASTDTSRHVESIAEWALADGRDAGIVTTTRITHASPAGVYAKVADRNWEHNQAVENDGFDTDKCPDIALQLVHKHPGNKLKVILGGGRLNFLPNDVKDEEGVYGNRTDTRNLIEEWAQDKEDRKVTHKYVWNREQLMSLKDDLPEYLLGLFESNHLQYNMQADPNTEPTLTELTEIAIKSLSRNEKGFFLFVEGGRIDHAHHRNWVELALDETLEMDKAVARAAELLSEDDSLIVVTADHSHVMAYNGYSARGHDILGPSRDLDLDGVPYMTLSYTNGPGFRSHMNGIRPDVTAEDGFGEDEWLAHVDVPLIDETHGGDDVAVFARGPHHSMFTGLYEQSQLPHLMAYAACIGPGRHACSGAAHALAQPVLLLSLLVLLTSLFQQ

SEQ ID NO: 39 - protein, 1021 aa, Spodoptera frugiperda
MASRWFNLLLGVILLQSVLAFGPIDVTDAEWIEYMGLINNPNYRLPTTTRPLHYKVRLQPNLDQDFELNGDVEINIKVESGNQPINEIKLHCQDMVINSLTVTSTTNTQVNLAQGTQFVCEETTSFLTIPTTTQLLNGNEYIIKISFVGKLQSGMRGFYRSWFFDENKQKRWMATTQFQPGHARQAFPCYDEPGFKATFDIILVRDDSLISLSNMPIRETITSTLYPQKKEDIYYTTPIMSTYLLAFIVADYKRIESGTNVNRPFHIYARGNVGDTGKYSLEVGEKLLTLMESYTQYNYYTMASHMEMKQAAIPDFSAGAMENWGLLTYREALILYDPENSNNFYKQRIANIISHEIAHMWFGNLVTCAWWDTLWLNEGFARYYQYYMTDKAEPHMGFKTRFIVEQLQMAMLSDSFSNAHALTNPAVSDPDSVSNHFSTITYAKGASILRMTEHLLGGDTYEKGLREYLKKREFNTAEPKDLFESLDAAANADNSLADYDDMTIAKYFASWSEKAGHPLLTVHVDHASGRMTVVQTQFDVNSGVSSDNGLWHIPLTWTRAGNPEFENLKPSEFMSGPLKIINRGSTGREWVIFNKQQSGFYRVNYDATTWALLTQALRSNEREAIHEYNRAQIVDDVFVLARSNILSYTRALNILSFLEFEDKYAPWVAAITGFNFALRRLAHKTEEQQKLKDIIFKSSAAIIQRLGYTEASNADPLFMDNLLRMHLMTFLCNAGHAQCSQTGREYFKAWRESGTRIPPNMRPWVYCEGLRTGDLADFDYFWNRYVDEDLSNEKVVMIGAAGCTGNTEALHKFLSVIVDPKPTEQSIELIRPQDYSAAISSAVTSNEYNTMKVLEWLKDNPSHLQNGNGVSLLRSAASRLLNEADIFKVETWFATITSDEAIQAIKDGIATSNNNIKWYNSRVGEFSDYFETGYFDDLTGGSETPDPTTPEPTTAEPTTPEPTTPEPTTAEPTTAEPTTDESTPAEPTTAEPTTDEPEPGSANIASLSFFTLLVTLIINMV

SEQ ID NO: 40 - protein, 765 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGEDMILDLTINKDLIPEGFFHKHQKNGDYKIHQPTFQEANICEYNGKVRGKPNSWVALSTCDGLSGVVFDGEEMHYVEKGNSIGDVEADHFLYRYSDLLEHNKTCGYAGDAVDPEKAIHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 41 - protein, 765 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGENMILDLTINKDLIPEGFFHKHQENGDYKIHQPTFQEANICEYNGKVRGKANSWVALSTCDGLSGVIFDGEEMHYVEKGNSIGDVEADHFLYKYSDLLEHNKTCGYAGDAVDPEKAVHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 42 - protein, 1421 aa, Diabrotica virgifera virgifera
MRTKLVIFLCLVLFVTSVYNEDIPVNSLLDELHPAAEFSRHTLVKPKLYHGREKRQISSTKEKSGKHTDHLQITMEVDGENMILDLTINKDLIPEGFFHKHQENGDYKIHQPTFQEANICEYNGKVRGKANSWVALSTCDGLSGVIFDGEEMHYVEKGNSIGDVEADHFLYKYSDLLEHNKTCGYAGDAVDPEKAVHAHNNNRILRYKRDTDEQLVRGPYNANKESKYVELVLVIDNQEYKELGESKTKVVNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKGTRHGNCGYDKLTQTFFKCENESVLCGMLHCEHLNEKLEFGMESVAMLSHTFINKKGLIIPCRTAIVDLGINQVDPGLTPDGALCGKGKMCVNQKCMSVSSLKKQGPHCPDDCNGNGWCNNKGHCHCKDGFAPPTCDYPGPGGSLDSGPAADPNARQGIVAALFIIFLGIVPLVAISAFLLYYVRHNLHFGRRKSTPSTTKSPSKSRGPPFASEVTKRTEDNHSLLREDSPPPIGFIGLSNNFFGNFKGFSIIPLKNETQPSRSAPPPPVIVPAKSKSSASSTSKPAKPAATQETKHSIFSNPIQKYNSFRKSNVPNGIVTVNQVSAAPALPPPNPGSHAKPIISSPILENSTCTAKELVSPLRNAPKLPIRAAPQAPSIEITRTLNRITSFLKPADKKPTIVSKPSQVKATKVLDKESLRNIEISNPIPQKNIEISVSTLPVDSATTKNVVMRAQSMRATKQTDRPNIQTFGSMRQPNGYKRPLSIPSGSRPKNPPPPRPPLEKSQEKSASDQSDQYDDCLNEEVPLATGTTTSPSGDNIYAVIEDSPVVSPENKPSNSGSSESMGLLGEIVNEIQSRNFDSIYSTSTLARKKKEEEEKKKAQLSPDSSETYVNTASLQYPESEYSNMSGNIKSSASSTSSGYILPSAINIPVKEETKPKEEPKPSLSSFKADSKPAVVNKPLASGFKPSQANLKKVETSPERKSKVLSSPTSKTPPKSVSRQITPPNLRTRKPSPTRPTAPVHKSNRSVTNSPDLVTSCNTNSSSKPPDIVGTNSVTKKPSITSAKPTVPLPKVKSNPKAVNAKVSQEKKGDAKPVVANKLNKTSTSDSTTKTSVGVRNAARSNSNVASLQQKFENKT

SEQ ID NO: 43 - protein, 1306 aa, Diabrotica virgifera virgifera
MDTGNKTTKPRNPAENTNPISFLFFFYMFPIFKKTYKYKLTEEELFSPLKEHTSSRLGSKLEKAWKEEYRIHKKTALHRALFRIFGLRYTVLGLIRLFDELLLIVVMPYCIRTLVAYLEAGQTKITKDEALIYAAALVITLLLDAVMQQPNYMGLQHIAMKIRVACSSLIYRKTLRFSREALGNTTVGQLVNLLSNDVSKFDQLFGLTHYAWIGPIQVALGTWLLYREIGVSAFFGMAILVAFVPLQIWLAKKMSVMRLKTALRTDERVKLMNEIISGIQVIKMYCWEKPFAHVIDLARRSEMRAIRSHSCLLGILYSFEVFVSRTAIFVSIVGYVLLGNYVSADKVFAITAIYNQMRTIITIIFSLSITALAEMHVTIDRIHKLMIFDEREQDSEDGYEKMNGNYQSKLNGLDGMKNGINGNGTAIELIKKVKEPKLMLSGVSAKWLAQSPENNLSDITFNVPPNKMLAIIGPVGSGKSSIINLILKELPVKSGKLEIDGKVSYASQEPWLFAASVRQNILFGEEYDEERYKLVVEVCALKSDFALFPHGDKTLVGEKGKALSGGQKARVNLARCVYKKADIYLLDDPLSAVDANVGKHLYDRCIKQFLSNKICVLVTHQLQYLRNADKIIIMKDGKMEMTGSYTELKKSGLDFAKVMEEFNEEAEEDKRMKSIKSKASIYDEPMEDEEDQVLEKEMQEKGTIKAATYYLYLKAGGGICSMLALGFLFIICQVVANAGEYYVTYWVNLEQDFSEKQRMNLTAPNETINRDLIMWSYTALIVGNIIISVVKAVYFMIFFVIASKNLHKYIFDKLIKATMRFYNTNPSGRILNRFSKDLGTVDEYLPSVIIDVIEIALLLLGAITLSAIVEPLLTVPAVVLMIIFYLLKIVYSETSRSVKRVEAITKSPMLSHLTASVNGLSTVRAFHAEKMLTEEFDNYQDSHSAAWFLYLASSKCFGLWLDIICIVFIAVAVFSLLLFRDTIHGGDLGLVITQYLGLMGSLQWGMRQWTELENNMTSVERILEYTRLETEPERKEPKNIPQPWPEKGLVEFRDVSLRYSPQDPPVLKGLNFTVQPKEKIGIVGRTGAGKSSTITALFQLYPLEGTVVVDGVDTTQIPLDLVRTNISIIPQEPVLFSGKMRENLDPFENYSDDVLWNALDQVELKDVISELPAGLNTEVTEGGNNFSVGQRQLVCLARALIRNNKILVMDEATANVDPHTDSLIQKTIRDKFADCTVLTIAHRLHTVMDSDKILVMNSGRVEEFNHPYLLLQNVHGVLHNLVDATGPSTAKNLENIAKESYEKKRV

SEQ ID NO: 44 - protein, 934 aa, Diabrotica virgifera virgifera
MWVILLLSILASATASNPDLASSDTDPDLFPVQRATEEAEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYTGNNNTQWYIPVTYRLSNSSSYETFWLAPNSSVTILNNLTDKDWLIVNDDSRGYYRVKYCKRLTQRIQSLLNQNHTQISELNRAQILDDSLNLARAGYIKYSEAFELLEYLKNETSYFPWFTTIKNMDYLVTRLGANTELGKRTNAMILDLISQISANISTTKWEEIDQVTTLKLQRVWADACKRGQASCISETKRLFQALRLNKTSVNPNIRDVVYCNALRNSNNIAADWEFLWNRLLISIHPQEDLYILLSLGCTTHKPYLTRLLDATINSTSVIKLQNLYTVWNSVGSASKEGLDLAFEYFVNNYKKIIEYYPDGISLLSQLANRFTTNAEVTKLQQFADRLEKNSTIRAVANSALTTARQNLQFRARIEDDLNDYFKIDNSGSSVTPLGIFMPLLLLSVVFFM

SEQ ID NO: 45 - DNA, 783 bp, Diabrotica virgifera virgifera
tatgacgagcaggttttctttagtgtcatgacaggatctatgaactttggtattgcctctccatatatagaggcatttggaatctcaaaagcggcggcgtcaaaaatttttagtgtaatcgatcacaaacctacaattaatttatcaaaaggaaatggaaaaacgctaaacgtactcataggaaatatacaatttaaagatgtggctttccgttatccatctaggaaagatgtaccgatattaaaaggattaagtttgaacattaaatctggagacactgtggcacttgtaggtagttcgggctgtggaaaatctacggttattcagttacttcaacggttatacgatgcggactctggagaggtcaccatagacggaaaaaatattaaagaatacgatttaacttggttaagaagccaaataggagttgtaggtcaagaaccaattctctttggaacatccattttagaaaatattaggtacggtaaagatggagtaacagaggaagatgtcattcaagcagctaaaaaagctaatgcgcataactttattaaagctcttcctaacggatataatacattggttggagagaaaggggctcaactctcaggtggacaaaaacaaaggatagctatagctagagctttggtaagaaatcctactttattacttttggacgaggctacttcagcactggataataccagtgaagctaaagtacaagcagctctagatgcggcaagtgttgaatgtacaactataattgtggcacacaggctatca

SEQ ID NO: 46 - DNA, 783 bp, Diabrotica virgifera virgifera; identical to SEQ ID NO: 45

SEQ ID NO: 47 - DNA, 3970 bp, Diabrotica virgifera virgifera
atggaaatgaccaaagagaaatataatcccaatccacgggagactgcgaatattatatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttggagtacgcaaagctaggaatatatactatcacgacagatttagtgctaagactcattcaacctctaatacttgggaacctattggattattttaaaccagaatcacaagtttccgaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaacggagttttttacagtatggttgctgaaactggtagaacaacagctgaacagctaagaaaaattgcttcagatagttatcaaaaactaaatgcattaccagagtaa

SEQ ID NO: 48 - DNA, 3972 bp, Diabrotica virgifera virgifera
atggaaatgaccaaagagaaatataatcccaatccacgggagactgcgaatattctatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttagagtacgcaaagctaggaatatatactatcacgacagatttagtgctaagactcattcaacctctaatacttggaaacctattggattattttaaacctgaagcacaagtttccaaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagtttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaaacggagttttttacagtatggttgctgaaactggtagaacaacagctgaacagctaagaaaaattgcttcagatagttatcaaaaactaaatgcattaccagagtaa

SEQ ID NO: 49 - DNA, 3972 bp, Diabrotica virgifera virgifera
atggaaatgaccaaagagaaatataatcccaatccacgggagactgcgaatattatatcggctctattttttggatatacgtatgatgtatttaagaagggcttatcgaagacgctggaagttgacgatttatataatccgttaaagagtgacagaagcaaagtcttgggagataatttacaaagaaattgggacaagcaactagaaaaatctaagaaatcaaattccaaaccaagtttattgaaagccattgttatgtcattttggttggagtacgcaaagctaggaatatatactatcacgacagatttagtgctaagactcattcaacctctaatacttgggaacctattggattattttaaaccagaatcacaagtttccgaaaatgaggctcttacgtatgcaggtatcctagtggccataaacatcttgaacattttgatgtcaaatcaatatatgctagaggtttttcacagtggcatgaggataagagcatcttgttgtgctgtgatatacagaaagtcattaaaattgagcaaaacagccttgggagaaacagcatccggaaaactggtcaacctattatccaacgatgtcagtagatttgatattgttagtttattcattcaccaattatggatggcacctgtattgtcacttatagtaatgggtatactgtaccagagaactgggtatgcaggagtagtgggagttgtggcagtatttgtgatagttccctttcaaacctacaccggaaaattatctgcaatatacagaaaacagactgctttcaaaacagacgagagagtcagactaatggacgaaatcatctcaggaattcaagttatcaaaatgtacgcatgggaaataccgttcaggaaaataatccgaattgccagacgaaatgaaataaaaattattacaaaatctgcttatgtgagagctacgtttatggcattgaatcttttcaccaccagattggcattgttctgtactttgctgacagttattttgtcgaacgaagaaatcacagcgtcgaaggtttttgttgtaatgggttatttcaacgttctttcaatggctatgtccaccatgtttagtagaggagtatctgaaatggcagaggttatggtagctattcgaagaattagagattttctcataaacgaagaatacgatcctaatagaacaaatttcgctatgaatggcaatgtaaacagtgtagacgattttaaagaaattataagtttgcaaaatttgactgtaaaatggaatgcaagcttcagtgacaatgctcttgagaatataaatataaatatttctgatggacagatggttggaattattggacctgttggtagcgggaagagttcattattgcaaacattactgggggaactggacataaccgaaggcagtatgagagttcgaggtcaaatatcctatgcttctcaggagccgtgggtttttgcgtccactgttcgtcaaaacattctttttggtgaagaatacgacaaaaagagataccatgaagttatagaagcttgctctttagagaaagattttgagcagttcccaaatggagatttaacactagtaggtgataggggatcatctttgagtggcggccaaaaagctagaataaatttagcaagagctgtgtatagagaagccgatgtatatctcttggatgatccgttgtcagctgtggacatacacgtttccaaacatctatatgaaaaatgtattaatggatatttggccaacagaacgagaattttagttacccatcaagtacactatttgaaagatgcggataacattattattttaaataatggacgcatagaagatgaaggaaccttcaattttttggcaaacagtgacaatgtttatgcaaaacttttaactgctgagccagaaaatgtagaagaaaagaaacaagatagatctaaatataataggcaactctcaataagaagtcgaaaagattcactggcaagtatagtcagtgaattaagcattgcggatactctcatatcgaatgatatcgactttgaagaagaagaagctgaaaagcaactcgaatttgatgtcaaagaccttcaggaacaatcatcaaaaggaaaagtgggcggttctctgttgtttaaatatatgttggcaggttctaattcatttgctgttttaatatgcgttatattgtatctaggaactcaattagctgccagtggggtagactactgggtaagctattgggtcaacgtagaggaattcaggagctccagcgaatcttctaattctactacacctacattcattattccatccattgaactgacaacaaataattgcctttatatatatgggttccttttaggagctctttttgttcttgctatgacaagatctttcttcttttataaacttgctatgtggagctccaaaaaactgcatgcgacaatttttgataatattgtcactgctacaatgagattcttcgataccaatccaggaggaagaattctcaacaggttttctaaagatatgggatgtgttgacgaattactaccgaaagcaatattggattcttcacagatgcttttgtctatgtgtggatctctcttactgatagtcgtagtcaatccttacttcttaattctgattggcgccttgagtgtagttttggttttatgaggcatgtctacctaaaatcttcgaagaatattaagaggttagaaggaataatgagaagtcccgtgtttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactattatttggggaggcctttaatctgaagggaggtcaagtaggtctggccatcactcaagcaacagcattaacaagtttactacaatggggtatgcgtcaatctgccgaggtaaccaatcaacttatgagcgtggaaagggtattggagtaccaaaatttggaaaaagaaccacaaccggtcgtacctcaaaaaccagcaaaagaatggcctcagaaaggagaaatcacttttaaagatacttgtttaaaatactttgagggtggaccattggttttgaaacatcttgatcttaaaattcaaccaaaggaaaaggttggagttgttggcagaaccggtgcaggaaaatcttccttaattcaggcactctttagactagccccaattgaaggttcaattaaaatcgatgacatcgacaccaaagacattagcctcaatgatctccgtttaaaaatctcgattattccccaagacccagtgctattttcaggaactttaagatacaacttggacccattcgaagaatattcagacgaagttttgtataaagctatacaagacgtagaactaaaagatcctgctaatgttattaaccgattggaaaatagagtcatggatagaggttccaattacagtgttggacagagacagttgatttgcttggcaagagctattcttaaaaataacaaagttcttatgttggatgaagctacggctaatgtagatccacagactgacgctttaatccagaaaactatcagaagaaagttctcagattgcactgtgataaccgtcgcacatagactgaacacaatcatggactctgataaagtattagttatggacgctggacaaatatctgaatttgatcaccctcacttactccttcaaaataaaacggagttttttaaaagcatggtttgtgaaactggaagagcaacagctgaacagctcaaaaaaaattgcttccgatagttatcaaaaactacaagcactaccagagtaa

SEQ ID NO: 50 - DNA, 3972 bp, Diabrotica virgifera virgifera; identical to SEQ ID NO: 49

SEQ ID NO: 51 - DNA, 2805 bp, Diabrotica virgifera virgifera; identical to SEQ ID NO: 22

SEQ ID NO: 52 - DNA, 2808 bp, Diabrotica virgifera virgifera
atgtgggtaatacttctcttatcaatacttgcttcagcaacgacggcttcaaatccagatttggcttcttcagatacagatccagatctttttcctatacaaagagcggccgaagaagtagaaatctccagtaacaagtatctgttatcatcaccagtaattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttatacactggaaataataacactcagtggtacataccggttacttacagattgtcaaatagctcttcatatgaaacattttggttggcacccaatagttctgtaacaatactaaataatttaactgacaaagactggttaattgtaaatgatgattctagaggttattacagagttaagtattgcaaaaggctaacgcaaagaatacaatctctattaaatcaaaatcacactcaaatttcggagttaaacagagctcaaatactagacgactctcttaatcttgctagggctggatacattaaatactccgaagctttcgagcttctggaatatttaaaaaatgaaactagctacttcccttggttcactacgattaaaaatatggattatttagtaacaagattaggagccaataccgagttgggaaaaagaacaaatgctatgatattagaccttataagtcagatttcagccaacatttcaactactaaatgggaagaaattgatcaagttactactttgaaattgcaaagggtgtgggcagatgcttgtaaaagaggccaggcaagttgtatttctgagacaaagagactgtttcaggcattaagattaaacaaaactagcgtaaatccaaatataagagacgtagtatactgtaatgccttgagaaatagtaacaatattgccgctgattgggagttcctgtggaacagactattgatctctattcatcctcaggaagatctttacatattactgagtttgggatgcacaacacacaagccctacttaacaagattattggatgcaaccataaactctacatcagtaataaaacttcaaaacctatataccgtatggaattcagttggttctgccagtaaagaaggtttagatcttgcttttgaatatttcgttaacaactacaaaaaaattattgaatattatcccgatggtatatcattattatctcaattggccaacagatttacaactaatgctgaggtcacaaagttgcaacaattcgctgatcggctggagaagaactcaacaatcagagctgttgcaaattcagctttaactacagcaagacagaatttacaatttagggctcgaattgaagatgacctgaacgattacttcaagattgataactccgggtcatcagtaactcctcttggaatatttatgcctttattattgttaagtgtagttttctttatgtaa

SEQ ID NO: 53 - DNA, 2996 bp, Diabrotica virgifera virgifera
atggttgggaaggttgattattcaagtgtgccaacttcggcagacttagaaaacaactcgaaccaaaagaaatacacagtgaaccaaaacggtaaacaaggcgttgtgataccgagatccctctgcgccctaatggcgatcggtgccttactattagctatactagtaggtctaatagtattcttcttagttcctagggattgtcatgcgacgaaatcccctcaagcattaacacatcaaccgccacagagcgctagcgtactgaatattaatagtaggggtagtagtagtaataatgatgacactaaggctgaaacgacgattgcaccgatagtgacgaaagtggaggttgaacaaaggctgccaaggagtatagaacctacacattatcgattacgaatattgccgcattttcaaaattctacgagtgagggttcagtgactatgactctgaacgttttagaagacacgaatgaaatcatcttcaacagcagaagcattttaatcgatgagcattccgttagcataagatcaaccaaacccgattctagtctgttagaaataaaggagcagctatactacgagaaggaaaaattaaaatagtactgaaagagcatttaagaaaaaatgaagagtaccaattagatttaaattttaatgggaagttgagtggacatttgcaaggattttataggataaaatattacgacgagtaccacaggcaaaggttaattgcctctacacagttttctccagttgatgcaagaagtgcttttccatgcttcgatgaaccatcgttcaaggccaatttccaaataactataggacgaccagctgacatgttatcactgtcaaatatgccgttggcccagaaaactccattttcaacgaacaactcagaactatggagttgggacgaatatcccgaaacccccaagatgtcaacgtatctagtcgctttcatggtaatggacttcattaaaggtgctggagacgatccccgaatgatgttttgggcacgaccacaaatcgctggaaactctgcttatgctgcccagataggacctaaaatcctcagtttctatgaaaactattttggcattaagtttccgctatctaaaattgatattgtagctgttcctgagtttggtttcagtgctatggaaaattggggccttataacattcagggaggatgttctcttatacgatcaacaatcatcaactaatgaggacaagagaactacagcaacaattttagcccacgaactagcacatcaatggttcggtaatctcgtgactccagtattttggaacgatctctggttgaaagaaggtttttctaatttcttggtatactcaggagtaaactatgctgaaccaaaatggatgtttgctgaagaattcatgctatctgaaaatctcgacgctatgagtgaagacgctttgcaaacttctagaccaatttccttcgataatattcaaaacacagttcaaattcgacagttattcgatcctatcacatatcgaaaaggagctgcaatagttaacatgataagcaacttccttggagaaaaaactttcaaaaccggtcttactaactttttgactaaatactcttacaaaaatgctgatagaaacgatttatttgcatctcttaccgaagaagcacataacagacagatcttgctaccaaatgaaactgttaaaatcattatggatacatggacagaacgagcagggtatcctgttatatatgcttatgctgattatgaacagaacacacttagactgtctcagaaaagattcctttaccgaatgagggacgaaaagtcaagctactgggttccgttatcatttactactaatgtaaagccaaattacactgacactttccctaaattttggctgaagggcgagtatgaaaccgtgcaaaatgttaacttatcggatatcaaatggtacctcctaaatttaaaccaaacaggttactttattgtcaactacgacgaaagaaactggatgagtctcgtcgaagccatcatggaagtgccaaccagcatcagggcgcagttgatctcagactccatggatttagcaagggcaaacatcattagctacgacatacccctaaggatgattgctaagatggcgattcgtgacaataacattatgtttgtaccaacagcgatagccttcgagaagctgaagtacttaagtgatatcctttcttcaacgccagcgttcggatttttcgagagtttccatcaaactattttcaaagaatcgtacaaaaaggtggcattagaagatcctttcgacgactatagaacaagaagaatccgtacaacagtactcaactggtcgtgtagaagtagtgagacaagatgcgcacatctctcaaaaatccagttcagacaatggatggtgggagcaaagagggttgaaccaaatctccagcaaatcgtctattgcacagccctaagggaaggaggacagatagaatgggattttgcctacaagaaatatatagaaatcacatctccaacagagaaaagcactttgctggacgctttgggatgtacaagacacacatggctgctctccagatacgttgataaaatcctgaatgatcccagtattcgcattcaagatgcagatcgagtttttcaatcggtggctaacaacaagtttggcacgcagatagcgtttgatttcttgagaactaactgggtggcgttactcaaacatcatggtgatggtttcaacgtcattgcgaagatggtcaaagctcttggaccacaaatgaacactgaattccagttgtcagagttaataagattccgggatagtatccacagcaacagcagctcggcatcagaggcaatcgcttcaacgatagaaacagtccgaggcaacgtagaatggatgcagaagaactaccaccaagtagagcagtggcttcgaaaaaacaagaacaatttcgatactttataa

SEQ ID NO: 54 - DNA, 1125 bp, Diabrotica virgifera virgifera
atgattcttatactgttcgcgttttccgcgatactttttaacggtgtacattccgtatgtcttaaaaattcgataacaactgcaagtggtttacacgcacccaagaacaagagtctctgttctggtcaactgatctttgaagacaactttaattggttggacacctcgaaatgggaccatgaacaaaccttaactggtggtggaaacaacgaattccaatggtatacggataatagacgtaacagttatacttacaacggccaattacacatcaaacccacttttgtcgcagatgaatatggagaagatttcttatattctggtactattgatataggagctgcctgcacaggtggcgacaacgaaggttgcagaagaactggttcacccaatgccatagtcaatcccatcgtaagtgctcgtatgaggacattgcactcattctcatttaaatacggcagggttgaagttaatgctaaaataccatctggagattggttatggccagctgtctggatgttaccaactaactgggagtatggaaattggccagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccatggtctggaggaactagaatggctccatttgacaaagagttccatcttataattaatttggctattggaggagcttatttcaacgatgaatttgacaataaagcttataagaaaccctggactagcactgaaccttaccgtcagggtatgacaaaattctggcaagctaatcaaaaatggaaaccaacctggaatttgaactcagatgactcacatcttaaggttgattacgtaagagtttgggctttgtaa

SEQ ID NO: 55 - DNA, 5067 bp, Diabrotica virgifera virgifera
atggctacgagaaatctatgtttatgtatgcttatttggatgccactctttgagggcatagttggcgacgtcgcctttggcattgcacaaattcctggtggtaaggcaacagtagaagatttgaaaaaagggaaatacttacttaacatggaagaaaataatcatggcggcgtaataccaactccactttttactattacaggggtggacaacactgattgtcctaatttgaatgttgaatttactcaaggcatgaagtttaagttttcgattaatgaaagttgtatattctatgctgaacagacatttgactacgaatcgaatgaaagatcatacaatttcagaatttcaaagtccgtaaatgacgagatagatattgcattcagtatcaaaaatatcgatgatgaacctccacaattaggaacgtttaaatgcaactttaatgaacaattagactatagtcttgatgacacaccatgcaatactacattgcatgatcccgacggatggctggcacaagagaaaattttaatattcatcgacactaaggatgaagatatattcgcaattgatttgcgaaagcctctaccaaatgatactgagacagacacctacgtttttatgtatctcttaaagcaacttaattatgaggataccaatttttatcagtttacagtgcaagcaaatgattctggaggtaatctttcaccacaagaaagtgctgtggtaaatgttatcaacattagaagtagacctccaaaatggtcaaaaataacattatttgatcaatttgacgaactgaccgaacaagattacgatatacaagctttagatggagatactggaattcatgcagatatttgttatgcaaaactaggtgaagatttaccagacaattacataaacgtcagtaccgataaaaccaataaaaaaggccatattcacgttaatcccattgatagagataaggatgatctaacactataccattttaacatttctgcctatgtttgtgatgccccagactattttactgtaaatacagtgcagtattacatcatcgatattgacaataatcctcccaggatagttgaaaatgttggggatgacggaaagaacacaacatttgacgatgataacgaccataaaaatgttacactaagttatttggaaaattattcgagatcgtataattttagcacaaccattacagatagagatacgggcgaaaacgcgcaattcactgtaagtctcgaaaatgttgagggttctacggttgattatacacaaccctatctaatagtaccggacaatgcttacaagacaggatcattcataataagcgtgaaaaataagaccttcctggatttcgagaacgacacttggaaaaagcattcctattatgttgtttccaatggaaaaaaagacaaatcaaagactgacagaatgttaatatcagtctcactagaagactataacgatgaacttcctattttcgagaaagaatcatacacaacagaaataaatgagactgttgcgaacggcactcaaatactatacacccatgcaacagacagagatgcagaagatttcgaactgaaaatgaatatagttggaacttatgctgagaataggctaagtattgataaagatggaaatattaaagtaaaggtagtcaatgccttcgattacgatgtcttaaattctgtgtatttccaagtaaccgcaacagataaggttaatcatgtgactagagtaccagtaacgattaacattttggatgttaataataaagctcccgtaataaatcaagtggaccatatacaaatcgaagaaaaccaacaaaacggtgtagtgctaaatgtaacaataacagctacggatgtagataccacggctaatctgactgctactataaattgggaagattccaaagttaccaaaactaatggtgctgtagtaaaaactgacgctgtaataaaagctatgcaatttttagagatagaaaatacacaaacagatgacggtctggaaatgaaactaaaggtaataaataataatgacgataatccagacaagccagattttgaaactttcgatacattgtatttaagtatagttgttgaagaccgtaatactgatcctgattttgaacaaaatcgatatacagaaggtcaaattgtcatcaatatccttgatgttaacgataatccaccatattttccaccttctaatgatgacactcgacaggtccaggaaatgtctctgaaaggagtatcggttggctccataaaagctgtcgatgttgatttgaattcagaaattacctaccattgcacgcccgaatatgaaaagtttgactgggtcgatgtaaatcttacaactggcgccataactgtaaagaacgataaacaagttgacgcagacacagacaaaacgtattatttcaactatacttgttgggctcatgatggtgtgttcttttccaaaccgttagacatctcaatctatgtcatcgacacaaacaacgaagtacctgtaatagattttccaaatgaagtacacgtaaaggaaaaatcacttatagatacagtaattaaaaagattgttacaagtgatttagatagagatgagccgtttcgtactgtaaactgtaattttgcaagcgatactgatccagactgtcaaatagaattctatattgataccaatgttcttaaagtgaaaagaaataaaactcttgatcgtgataagggaagaaaaacatatccttgtctatttgagtgcttggataatcctttaaatgttcgatcccaaggacaaaataaagccaataaaagctttactataatattggatgatataaatgatcatgcacctgtgcttatgacgaaggacctacaatgttctgaaaatttgaataaggacggcgaagtaggagagggcataataggagaagatattgatgatggtgataatgctaaaatagatttttctgtgttaagtatcgttgataaggaaaccaaaaatgacattcaagaatcttttaatatttctaaaattgatagtgattatgtattgaacgatacattgaagaaagtgcatcttatagccttcgaagatctcaaaggaaaatatggaacgtatgaagtcactttacacatgcatgacgaaggagatccaatgcagacaacagatccggatccaactttaacacttacaattgaaaaatggaattaccaaacaccaagtataatatttcctgaaaacgatcaaacatacattgtcctatcggatcaacaacctggtcaaccattggcactgtttaacaacactggaacttcaaatactttgcccgattttagtgcaacagatggtgaaacgaaggactgttctaagtgggatgtgaaattttcttatacgcagactaattatgaagatgataaaattttcgtgatagaccatatacagccgtgcgtttctcaactacaagtcagcaaacatttcaactcggatctagtacgaagtaaaaagtataagctaactattacagccagtgttaaggatggagcagaacaggaaggtgaagcaggttactcgacatcagcaaatataagtatagttttcctcaacaacgacgctcagccgatctttcaaaatagtgactggagtgtatcatttgttgaattcaatacaacacaacctgcgaaacctttggaagaacaggctgagtatgagaacacgaaaggaggacttcctatctattaccatttctattccgaaaaccagaccctttccaaatattttgaggttgatgagacgtccggtgatttatcggttataggaaatcttacctatgattatgatcaagatatatcgtttcacatagttgcttcgaatgactcacaagtcagaatgttggatccacgatccagtctaaatgttactgttaattttcttccacgtaaccgcagagctcctcagtggaaaagtaccaaattctttggagcagttatgcctacattcgtaactgggaacctcatagtcaccgctcaagctcatgacgacgattatatcgatcaacaacgcggattaacgtgttctatatctagtgagattaaccgaattggggaaggattagataaaataataggcgaaccattttatttgagcactgaaaatgatgccgccaaaatatttttggactttacagtgcagactacaatgaccggtcgatttgaatttaaaatcaaagtagaggacaatagagatgactacggcaatggtccatttgaaagtgaagctgatacaacaatatttattattactaaagacaacaccgttgattttcaattttacaacgatattgaggatgttcaggacagagaaacaccgatgttaaaaataatatccgatatagtgggatatgatgcatatcgtcaaaatatagatacagtaacaaatagcggtctcgttaggaccagagcaaggctttatttcattgacagtaaaagcagccgtcggttgcaacgcactaaaagtcccgcagacagtggattcgaactggttaatagtgaaacaatattaaacatagtgaccaatgtgaacaccttccaaaatctggccagcaccttgagaagtgaacaaaaactgaacctcgacagctttgaaacgaattccaaatccggcaacagcgaagcagcactaagagcttggttgatcggagtgtccgtggtcttggggatcttggtcttgcttttactaatcactttaatactaaaaaccagacagttaagtaacagaattaaaaaactaactaccccccaatttggttctcaagagtctggacttaacaggatgggcataaatgcacccaccaccaacaagcatgccatcgaaggaacaaatccagtatacaataataacgaaatcaagaagccaaaaaatatgaacgattttgatactcacagcataagaagcggtgattctgatttggttggaatagaaaacaacccagagtttgactacaacttcaacactaacgaggataaaactacatatctctaa

SEQ ID NO: 56 - DNA, 3774 bp, Diabrotica virgifera virgifera
atgggaacaaaaaaggatgatattaaggaaaaaaagacaaatgctctagatgcaaaatttgtaaaaaagaaagaaaatgagacaaaaattaaacctatatctttttttggaatgtttaaatatgccagcaaaggggacaaactcctgatgtttattggaactctatcggcagtaatcactggttgtctaccaccaataaatacaattttattcggagaacttgcaggaaatgctgtgcaatatgctgaaactttatataacgctaccttatcacaaaacgaacaagctgaggctcaggaaaaattctttgatggtattaaatttttcgctttggcgaatagtatggtcggagttgcgatgctttgttttagttatctttctaccatcacttttaattattcatcaacgaaacaaatatttcaaattagatctgattacttaaaatcaattcttaaccaagatatatcatggtatgatcaaaatcaaacaggcgattttgcaagtcgaatgtctgatgatttgtccaaatttgaagatggaataggtgaaaaggtaccaatgtttatacattttcaagtactctttgtagcagcagtaggaacagcattggccaaaggatgggagctagccttgatatcactggtagcaataccagcatccttggtatcttttggagtgataaatttgttaacaacaaaattagccaaaaacgaaatggaagcctacgcagcttcaggttcaattgctgaagaagtattttcattgatcagaacggtaacagcttttggtggacagcaaaaagagattgacagatataaggagcacctggtgtctgcaagaaaaaataatattaagcgaacaatgatcgttggtatcggattcggattggtgtatcttctattatatagtagttatgcactgtcgttatggtatggggtaaagttggtgttaaaagacaggtttaatcctaatgctagttatactccagcgaatatggtaacgatatttttcgccgtattgtcagcttccctgaactttggtgcagcttccacatatttagaaatgtttgccatatccaaagcagctgctgccaaaatttttaatgtaattgaaagcaaacctgatataaatttatcaaaatcaaatggggcaaaattggatcatttgaaagggaatattcaatttaaaaatgtcaaatttcattatccatctagaccagatataccggtactacaagggctggatattgaaattaatcctggggagactgttgctcttgttggaagttcgggatgcggcaaatctacggttgttcaacttatacaaagattttacaatgccgtatctggtgagatcttagtcgatggaacaaatattcaaaatttggatttaacatggtaccgaaacaatataggcgtagtaggacaagaacctgttttgtttggtacaaccatcctagaaaacattcgatacggaaaagaagaagctacagaagaggaaattatagaagccgcaaaaaaagcgaatgctcatgcttttattaagttgttaccaaaaggttataatacactggtaggagaacggggaacccaattgtctggaggacaaaaacaaagaatagctattgctagagccttggttcgaaaaccgactctattgttgttggatgaagcgacatctgcattagataatgctagtgaagctaaagtacaagaggctttagatttggcgagtgctgaatgtacaacaataattgttgcccatagactgtctacaataagaggagctaacaagattatagtacttcttgaaggaactgtagttgaacaaggaacacatgatgaattaatatcattaacaggtgagtattttaagcttgtaactgcccaagttgcaagttccaatcagatcgaattatcaaatgatgaaacagaaacaaaaggcaataatgaagcatatgaagaatataacgacgattatgatgacatatctcacgatgaaaaaaatgaaatagatgactttaaaaatggcaaaaaaattactctttttagcatcatgaagttaaatgcaccagaatggccatatattttaattgctggagtaggatctatagtagttggttggggatggccaatatttgctgtgttctttggtagtgttcttggaacactggcaaaatacgatacagagtatatagaaacagaaactacaagatattgtatatttttcgtgattgcgggtgtcatatgtatgatctcagtatttcttcaaaattatctgttaggaatagcgggagagaaaatgacagaacggattcgaacccagatgtttacagcaataatatcccaagaaatgggtttctttgacaaaaaatctaacggtgttggggcattatgcgcaaaattagctggagattcatccagcattcaaggagctactggacaacgagtgggtgcaatactgcaatctctttcaacgttcggtatagcaatagctctgtcaatgtattaccaatggaaactaggtctgttaatggcatcctttacaccattaatgttggttgcaatatttatagaaaaacgtaacactacaggtctaagtgaggccagagaaaagtccttacaaaaatctacaaagattgcagttgaagctgtgggaaatataagaactgtggcaggtcttgtcgcggaggataagtttcaaaaaagttatattactgaattgaaaccccactacaaagcagcgttagcagcagtgcattggagaggactagtttttggactgtcacggagtcttggatattttgcttatgctgctgccatgtactatggcggttttcttatacgagatggactatattatgataaagtatttaaggttgctcaagcacaattgatgggaaccatttcaattgctaattctctagcatttacgcctaatttaaacagaggtataagtgctgcgaagaggataaagagtttcctatccagaatcccccttatcagagatggtccaagttcaaaaccaatgaaccaggtagacggtaatataggttattcaaacgtagagtttttctatcccacaagaaaaaatattcaagtactccgtggtctgactatcaatattccaaaaggaagtactgtagcacttgttggtgaaagtggatgtggaaaatccactattatacaacttatagaacgattctacgatccatcttctggagatattaatttagatgaacaaaatattaaacatataactttaagttcgttaagatctcatttaggaatagtgccacaagaaccaaatctttttaataagtctattgctgagaacattgcctacggagacaactctagaaatgttcccattgatgaaattattcaggctgcaaagaacgcaaacattcataattttatagttggattacccaatgggtacgatacagaattaggagaaaaagcaactcaattatcgggtggacaaaagcaaaggattgcgattgctcgtgctttggtacaaaatccgaagattttactcttagatgaagctacatctgctttagacacagaaagtgaaaaggtagtacaagcagctctcgatgaagctaagaagggaagaacatgcatcacaatagcacacagactgacgaccattcaagatgcagatataatatacgttatcgataaaggaatcgttgttgaatcgggaacccacagagagttattaaataaaaatggtttttattataaattgtatactcaaaaacattaa

SEQ ID NO: 57 - DNA, 3870 bp, Diabrotica virgifera virgifera
atggacacggggaacaagaccactaagccccgcaaccctgcggaaaataccaatccgatttcttttctcttctttttctacatgttccctatcttcaaaaaaacgtacaagtacaaattaacagaagaagaactattttctccgttgaaggagcacacatctagtagactaggatcaaaattagaaaaagcatggaaagaagaatataggatacacaaaaagactgcactacatagggctttatttaggatatttggacttagatatacggtcttagggttaatcagattgttcgacgaactcttgttaatagttgtaatgccttactgtatacgaacgctagttgcatatttggaagcaggacagaccaaaataacgaaagatgaggcgttaatttatgcagctgcacttgtgattacacttttactagatgctgtgatgcaacaaccaaactatatgggcttacagcacatcgccatgaagatacgagtggcttgctcgtctttgatatataggaaaactttgaggtttagccgagaagctttaggaaacactactgtaggtcaattagtaaatttattatccaatgacgtaagcaaatttgaccagttatttggtttgactcattacgcctggatagggccaatccaagtcgctcttgggacgtggctattgtatagagagattggagtgagtgccttttttggtatggcgttcctagtggcgttcgtcccgcttcaaatttggttagccaaaaaaatgtctgtgatgcgtctgaaaacagctttgaggacggacgaaagggtcaaactaatgaacgagattatctccggtattcaggtgattaaaatgtattgctgggaaaaaccgttcgctcatgttattgatttggcacggagatccgaaatgcgtgcaatcagatcacactcctgcctattaggaatactctattcattcgaagtattcgtgtccagaactgctatatttgtgagcatcgtaggctacgtccttctcggtaattatgtatcagccgataaagtttttgctattaccgccatctacaaccagatgagaacaatcattaccatcatattttctctaagtataacagcattggccgagatgcacgttactatagataggatacataagctaatgatatttgacgaacgagaacaagactctgaagatggttatgaaaagatgaatggtaactatcaatctaaactgaacggactagatggcatgaagaacggtattaacggaaacggtacagctattgaattaattaaaaaagtcaaagagcctaaattgatgctatctggagtttctgccaagtggttagcacagtctcctgaaaataacctaagtgacataacattcaatgtccctcctaataaaatgctcgcgatcattggaccagttggtagcggcaagagcagcatcataaacttgatactaaaagaactaccagtaaaatcaggaaagctagaaatagatgggaaagtgtcttatgcctcccaggagccatggctttttgctgcgagcgtacgtcaaaacatcttgttcggtgaggaatatgacgaagaaagatacaaactggttgtagaagtatgtgccttaaaatcagattttgccttattcccccacggagataaaactttggttggagagaaaggaaaagctctaagtggagggcaaaaagctagagtgaatttggctagatgcgtgtacaaaaaagccgacatatatcttctagacgatcctctatcggctgttgatgctaacgtaggaaaacatctctacgatagatgcatcaaacagttcttgtcaaacaaaatatgtgttctggttacacatcagctacagtacttaagaaacgccgataagatcattatcatgaaagatggtaagatggagatgactggaagctacacagaactaaagaagagcggtctagacttcgccaaagttatggaagaatttaacgaggaagccgaagaagacaaacggatgaagtcaattaaatcaaaagcgtcaatttacgatgagccaatggaagatgaagaggaccaagttctggagaaggaaatgcaggagaagggtaccattaaggcagctacttattatttgtacttaaaagcaggcggtgggatttgttcgatgttagcactgggcttcctgtttattatttgtcaagtagttgctaatgccggagaatactatgttacttattgggtgaacttagaacaagattttagcgagaagcaaagaatgaatttaaccgcccccaatgaaactataaacagggatctgatcatgtggtcttacactgcccttatcgttggtaacataatcatatcggtagtcaaggcagtgtactttatgatttttttcgtaatagcttctaagaatctacataaatatatatttgacaaactaatcaaagcgacaatgagattttacaacacaaatccatctggaaggatcctaaacagattttcgaaggatctaggaactgtggatgaatatttgccttctgttatcattgatgttattgagattgcattacttcttcttggagctattacactatctgcaatagtagagcccttattgactgtacctgcagtggtgctaatgataattttctatttattgaaaatagtgtattctgaaaccagtagaagtgttaaaagagttgaagcaattacaaaaagtccaatgttgagtcacctcacagcttcagttaatggattgagcacagttagggctttccacgctgaaaaaatgttaacggaagaattcgacaactaccaggacagccacagtgcagcatggttcttatatttggcttccagtaaatgttttggactttggttagatataatctgtattgtcttcatagctgtggcagtattttcgctcttgttgttccgagacacaatccatggaggtgatttaggtttagtcatcactcagtatctgggtctaatgggctcactccagtggggaatgcgacaatggaccgaactagaaaacaacatgacgtcagtagaaagaattttggaatacacccgtttggaaacagaacctgaacggaaagagcctaaaaatattcctcagccgtggccggagaagggtcttgttgaattcagagacgtcagtttgcgatacagtccacaggatccgcctgtacttaagggactgaactttacagtacagcccaaggagaagattggcatagttggaaggactggggctggtaaatcgtcaaccataacggctctctttcaactctatccacttgaaggaactgttgtggtcgatggtgtagatacgacgcaaataccgttggatttggttaggactaatatttcgattataccacaagaaccagtgcttttctcaggtaaaatgcgtgaaaacttggatcctttcgaaaactacagtgatgacgtattatggaacgccttagatcaagttgaactgaaagatgtaatatccgaactgccagcaggcctcaatacagaagtcacagaaggaggaaataacttcagtgttggccagaggcagttggtttgtctggcgagagctcttattagaaataataagattttggtcatggacgaagctaccgcgaatgtggatccacacaccgattctttgattcagaaaaccataagggataagtttgcggattgtacggtgctgacaattgcccacaggctacatacggtaatggattctgacaaaatattggttatgaattccggcagagtggaggaatttaatcatccatatcttcttctacaaaacgtacatggtgtgcttcacaatttggttgacgctactgggccttctactgca

SEQ ID NO: 58 - DNA, 3852 bp, Diabrotica virgifera virgifera
atggattccacaaaggaaacctacaatcccaatccaagggacagttccaatatattctcaatattattttttgggttcacgtatcccatattcaagaagggcatgaagaaagactttgacgtggaagatttgtataacccattgaaaaatgacagaagtactcttttgggagataagttagaaaggaattgggacaaacaaaaacttaaaccaaaaggcaaacccagtctcctccgagcagtagcaattacatattggtacgaatatctacgattagggttcctcacattgataggagatgtttttattcgagtaagccaaccttacgttttgggcttgttgctcacctattacaacccacattccaaaaccaccaaggaacaagctctagggtacgctgggatgatagttacttttaatactctaacgtcgtttataaagaatcagtatatgatgaattctatgcacgctggtatgcgagtaaggacttcggtgtgtgctcttatttatagaaaggctatcaaattaagcactactgccctcggcaaaagttcagtagggaagattgttaatcttctttcgaacgatgtaagcagattcgattcagcctcgatgttactgcaccaaatgtgggttggaccagtttctgcaataataattatgtatatcatttttcaagatattggatggtccggagcaactggagttgttaccattgttacaattatgcccatgcaagcgtatattggcaaattatcagcaaaatatagaagaataatcgctggtaaaacagatgaaagaataagactgatgaacgaggtcatagggggcattcaggtgattaagatgtatgcgtgggaaataccgtttacaaaattaatcagccttgcacgaaaagctgaaattaatgttattagaagaagcgcgtacataagaggtgtatttatggctttcaatttattcaacaatagatttgctttgtttgcaactttggctacgatggtatttactaacaaagctatcacggcagcaagagtgtacgtttttatgtcatattaccaaatcctagctaacacactagctggagtattcgtcaatggtcttacacagattgctgaacttctagtttccattaacagaatcgaagagtttctcgaaaatgaagaacacaaagaattacctgccctaaaaagatctgtaatctcgaacgtcaatgaagagatggtagcttgtaagaatatggttgcgtcttggaatgaaaactcacttgatcctgttttgaaaaacctaaattttaaacttggaaaaaatactctacttggtgttattggtcctgttggcagtgggaaaagttcattgctacagtctattttgggtgaacttgatatagttgacggaagcctagccgtccacggcacactctcctacgcctcccaagaaccttggatcttttccggcagtattaggcaaaacattctttttggttccgactttgacaaagcccgctatgatgaagtattaaaagtatgcgaactcagaaaagattttgaccaattccccgaccgagatttcactctgataggagagaaaggcgccaatctcagtggtggtcaaaaagctaggattaatctagctcgtgctatttacaaagatgctgatatatatttactggatgatccactttctgccgttgacagtattgtttccaaagtattatatgaagactgcattaatggatttttagctaagaaagcaagaatattagtaacccatcaagtttattatttaaaaactgctgatcacattctcgttctcaataatggaggcatcgaaattgaaggcacctattcagaactactaaaaagcgacaaccctctcactgtccacttaaccgaagaaatcgaagaaattttaaaacgtcaaaagtctcaagattctgctatagaagaacaggaagctaagactatgagcacgatggatctttccaaaatgaatggaaaaatgaaagccattgtcaaagaaatgcaagaagaaacatctaaaggaaaagttaaaggttccttattcctcgaattctttaagtcgggcatgagcatctgcgaaataatatttttagttactcttcttactatagctcaagccagcgccactgttatagattggttcattagtttctggacgaatatcgaagagtaccagatgacattgaactctaccgcagctaatgtattaaactctaccgtagttgatgcattaaactctaccgcagttgatgcgataaactctaccgcagttgatgtgttaaattctaccactgtgaatgcattaaactctactgtagttgatgaaagtgtgcccttttacatgaattggagtagccaaacttgtttgataatttatggtgcaattttagtcttttgcttggttacaacgttatccaggtcacttagtttttacagatttattctaaattgttctgagaatttacacggcatgttgttcactggagtaactaatacatatatgagattttttgataaaaatccaagtggaagaatcttgaatcggttttcaaaggatattggttctgtagatgaaatcttgccaaggatgttattcgaagcttctagggtcaccctcaaaatgcttggacacttggtattagtcctttacgtaaacccggcatcagttatcgttgtaataatattgggaattttgttttcctttattaggatagtctatcttcgatcatccaacaatattaagcggctcgagggaagaatgaaaagtccagtctttagtcatctgacagctacattggaaggactcaccaccataagagcctttaaagctcaaaacatccttagagcagaattcgacaagcaccaagatagccacaccagtgcttggttcatgtttattagtaccagttctgcgtttggattttcattggatgtcatctgtttgatgttcattggatcgttaaccttcagtttgattgggctgggtgaatattttaatttaaccggtggtgacgtgggtctagctattaatcaagcttcgtcgcttactcaaaacatacaatttctggttcgtttctctgctgatatctccaatcaactaatgtcagtggaaagaattttagaatataaagaattgataccagaacagcaaccggaaaaactactgttacctccaaaaagttggccggataaagggattgttaatatagaacatttaaatatgaaatatatagatgatggtcccactattctaaaagatgtcagtgttaagattaatccaaaagaaaagattggtattgtgggcagaactggagcaggaaaatcttcattaatatcagccatattccgattgactcctctagaaggtaaaatctacattgacgatatcaataccaaagacataacactaaaacagctaagatctaaagtttcaattataccccaagatcccatcttgttctccggcaccttgagatataatctagatccctttgatgaatacagcgatgaaactttgtacagagccttgaacgaagtcgaattaaaggatccgagcaacattattaatcgtttggaaaacagggttatggacagaggatcaaactatagtgttgggcagaggcagctaatatgtttggcgagagctattataagaaataataagattttggtcttggatgaagctactgcaaacgtggatccacagactgatgctctaatccaaaggactattagagaaaagttcgcagattgtacagttttaacagtggcacatcggttgaacacaatcatcgacaatgaccgaatattggtgcttgaagcaggagaa

SEQ ID NO: 59 - DNA, 2907 bp, Diabrotica virgifera virgifera
atgtcaaataaaatagtgactttagctttccggactgaagccaaaaaattcttaaccgttttacataaaccgttagcttacaacagaaataaaaattggttcagtagaacttctaaagtaccgttaccgttaggaaaggaaagcagaaacgtccctggttcagtccccttcaaaaaccgtcgcaccaatctcctgcgcttgccgcaatcggttgctgtgtcagtggggcgaagtcaacattattgttgtagtgagtggttaagttctataagttatagtaagagacgtctctcagttcagaaaacatcgaaaaatatgcctgaaggaaaacctttcgaaaggttgccgcaaaatgttaaacctaaaaactaccgcctgtccctcgtgccagatcttacagccctgactttccaaggaaatgtttctatagaagttgaggttgttagcaacacggatacagttgtacttaattcattagacttaaaattaaacgaggttactttaaaaggagataaatccctaaaacctggtcaagtagaattatgtgcggaagaagaaattgcgactttaaaatttccctctttagtgaccccaggctcctacattttagatatagcatttacaggtgaaattaacgacaaaatgaaagggctatacagaagtaaatatgtaaaccaaaaaggagaggaaacatacgcagcagtaacccaattcgaatcgacagatgctcgtcgttgtttcccatgttgggacgagcctgcccataaagccacatttgaaataagccttactgtacctaagaacttagttgccttatcaaatatgccagttaaaaatagtcaacctgaaggtgatctcattaaatatgactttgaaaaaacccccattatgtcaacgtacttagtagcagctgttatcggagaatacgattatgttgaggacaagtcgagtgacggtgtactcgttagggtgtatactccaaaaggaaaaaaagaacaaggactgttcgctcttgaagtagccacaaaagtattgccttattacaaagagtattttaatatagcttatccactacctaagattgatttgatcgctattgcggacttctgcgctggtgctatggaaaattggggccttgtgacttacagagaaacctgtcttctcgtagatcctaaaaacacttcggctgttagcaaacaatggattgcgctagtcgtaggtcacgaacttgctcatcagtggttcggaaatcttgtgactatggaatggtggacccatctgtggttaaatgaaggttacgcttcatttgtagaatttctctgcgtcaactacctcttccccgagtacgatatctggactcaatttgttaatgattcgtacatcaaagctctagaattagacagtttgaaaaattctcatcccatcgaagtacctgttggaaacccctccgaaattgacgaaatattcgatgacattagctacaacaaaggagcttctgttataagaatgttgcatcattatatcggagatgaggatttcaggaaaggcatgcatttgtacttaaccagacatcagtacaaaaatactttcacagaaaacttgtgggctgctttagaggaagccagtcaaaaaccagttggggacgttatgtctttttggaccaaacaaaaaggatttcccgttgttaaagttacacagcaaccggcaggtgacggtggtggtgttaaactaacgctctcgcaatctaaattcaccgcagatggatcgagtccagcggacgaagattatctgtggatgataccaatttccatatctacctccaaacatccttccaaagaagtagtttgcattgttctcactacgagaacggcagaaatcgttgtacctgaagttggaaaatcggattggattaaggttaatccaggagctattggcttctatcgaacccaatacaccccagaaatgttggagaagtttattcctgctattagggatagatctctaccgccattggataggttaggtttattagacgacttatttgctatggttaaagctggacatacaagtactgttgaagttttaaagcttcttaacgcatacgaagacgaacccgattacaacgtttggtgttcgattgtaaatgttctcggacgcttaggacaacttttgggccatacagaatatgaagcagactacaacaagttccaaaagagactcttgagcaaagtgtatagcagattgggatggacacaaaaatcaggcgaaacacatctcgataccctattaagagggttagtattaggtcgattggcgtggttagatcacgaacataccatatctgaggccaggaacatatttgatacccacgtcaaatctgagcaagtgctacctgccgatctgagaagcgcttgttataaaacaattttgagagctggtggtgaagctgaatacgacactttattgcagctgtataggtctagcgatctccacgaagaaaaggatagaattagcagagcatttggagccaccaaagatccgaaattgttaaagaaagttctggaatttgctatgtcggatgaagttagatctcaagacacagtatttgtaatagcttcggtgggattgaacagtactggaagagatatcgcttggcaattctttaaagacaactggcctcaaatcagggaacgattctacggttctcttcttacaagattagtcaagtatctgacagagaatttcgccagtgacgaaagagccaaagaagttgaagctttcttcgccgaacacaaacccccaggtacagagagaactgtacagcagtccatcgagacaattaatttgaacacaacttggctaaatagagactcggctgccattaaagagtacctcagaactatataa

SEQ ID NO: 60 - DNA, 2301 bp, Diabrotica virgifera virgifera
atgtccaaagactctcgatatacgccagtgaatacaaatccagataaaaatccaacatggtggaagcgacgtacaagtatggagaggtgtctaaccttatcaacgggtattgcccttcttattggaatctccttactcatagcacttgccacagtattatatagcagagatcaacatgttagtaataaaccgtacacagcccaaccactacaaggaaaaatagtcacaattacatcccaagatcacgaagatgaaaaagtatgtttaagtccaggatgcattcatactgcatcacgtgtattggaatatatggatgaatcggttgacccttgcgatgatttttatcaatttacctgtggtaattttatcaagaagacaaatattcctgatgataaatcctcagtaacttcatttactctaattggtgatgaacttcaagagcaattgagaactatgatcgaggaaccgatccaagaagatgaaccaaaaccattcaagcttactaagaaattatacaaggcatgtatgaataaaactttgattgaagaggatggaatgaccactattacagaagtgctgaaggagttgggtggttggcctgttttagaaggagattcttggaatgaagatgattttgattggaaaaactctgtatataaatttcgaaaagtgggttatggcgtggattattttattgatttttctgttgttggagatgtcaagaattctaccaagagagtaattgatttggatcaagcatctttgggtctgagacgggaattcttaatcaagggactcgatgaaaaaatagtcaaggcctattacgattatatggttgatttagcagtactgtttggagctgagcgagagagagcagctaaagaattaagagcttctctagagtttgaaattcaattagctaagatatctctgccaagtgaaaaacgccgtaacatgacagccttatataatccaatgacgattgaacagttgcaagaaaaatttagaagtattccttgggtagaatacattaataaccttctagccccggatacaaccgtagaatctggtgaaattgtagttgtaaacgttccgtcgtaccttaaagctttcgaaactctagttagcaagacgccaaagagggtacaggctaattatgtaatgtggagagctgcatcaaactcagtatcatatttaacagaacgtttaagaaagaggcaattagactacacagcagtaattactggcaaaacagaacgagaacccagatggaaagagtgcattgatattacttcagtcagtttatccattgcatctggagctttgtacgtaagaaaatactttaacgaacaagcaagacaaaacgctattgatatggtaaaagatatcagagctgagtttcaagatattttgaaagttgttgattggatggacgaagaaacaagagaaaatgcattggaaaaagctaaatctatgacgtcgcacattgcctatcctgacgaattactcgatgatgaaaaacttaaagaattttatgatggtctggaaatggaccgtaaccaatactttaaatcaattttaaatctaactctgttcggaacaagattttcattcaaaagattgagacaacctgtaaataaaactgactggattactcacggaagacctgctattgttaacgcattttattcatctattgaaaatagcatacagttccctgctggtattctccaaggagtattctttaacgctgatcgtcccagatatatgaactatggtgcaattggctttgttattggacatgagatcacacatggttttgacgatcaaggtagacaatttgataaagtgggaaatttagtagattggtggcaagaaacaacgaaaaaacgatttgtggaaaaagctcaatgtattattgatcaatatgctaattacactgttccagaactaaatttaaatctgaatggcattaacactcaaggcgaaaacatagcggacaatggcggcatcaaagaagcatacttggcttacgatcgatgggtaaaacggaatggggaggaatactttttacctggtctcaactacactggtagacaaatgttctggatgtctgccgcaagcatttggtgttcggtaacaagaaaagaagaacttcagcaaatgataatcaccgacgagcatgtacctgataaatttagagttaatgggcctctcgctaatatgaagtattttgcggacgatttcaattgccggaaaggagctccgatgaaccctgaacataagtgccaagtttggtag

SEQ ID NO: 61 - DNA, 2787 bp, Diabrotica virgifera virgifera
atgactccactttcgtttctctctgtcctactagtttttctgcctttcgtttaccttcaagaatatcgtttaccaaaaactgtagtaccgtcacattatgcattgtccttcacgtttaatcgacaagtatttgctggaactatattcgagttcagtggatcgacagttattacaataaaaacgtcagaaagtgtagccaacattcaattgcatgcagatccgtcgtttcttcgtattggagccataagtttggaccagggtggcgaaattgatagctacaatgtggatgccgttactcaaattttaacaataactactaaagcagctctaaatcccgaaatcgaatataagctaaccataacctatagagcggacataagtaccaaagaaatgataggactttatcaaagtacctatcaagatgccaatcaagctacaaattatctagtggctacccaactggagcctacctacgctagaagagtctttccttgttttgatgagccgtcgtttaaagcaacttttcaagtcagtttcacccttggacctaatatcaccccaaggacaaatactaagcttgaatcatccaatcagatgacaccaagcatccttcaatatacctttgtaactactccagtcatgtcaacatacttgctgtcttttgttatatcaaatttagactgcaccgatgctgctaccatcaacggagtacagaattctgtttgctctagaccaggtactgagaacttaagagactgggctgtgaatattgctccaaaaattcttgcaagtcttggagagtacactaagttggattataacttggcgatgaacaaaatggattatgtagcgattcctgatttttctgttgaagctatggagaattgggggctttccacttatagggaacaaagtttactatacgatcctgaacattcaaccaatatcgacaaacaaaatgtagctacactcctcgcccatgaaatagctcatcagtggtttggcaacctggtaacttgcaactggtggtcagaaacattcttaaatgaagcttttggtgactactttgagtactttgctgcacatatgatcctacctgcttggcaactggacaaacagcatgttgtcaacaacgtccagaaggcactgagggccgatgaagggaacctaccagcgctccagagcactgtatcctctcctgtagagattttaggaagatttaatgtggtttcctatactaaaggaagcagtattctgcgaatggtagaacatattttgggttcagaaaacttcaaggatgggatataccattatctcaacagtcacaaatttaaaagtactacgtcaagcgatttgtggagaggtttccaagcgtatttagacaattcctattccattttaccaaactatctaaatttgggagccgtgatgaacaattgggtagtacaatcaggatttccgttagtgacggttacagttagcgagggaaatgtgcagatagaacaaagaagatttggtgataacggaactgacgacaattctaaatggtatgttcctattaccttcatcacttctggctcatctggagttccttctactcgtccaagctattggttaactcctgaaaataacgtagcctttcaattaccgcaaggtgccgagtggattattgttaacaatcttcaaacaggatactatagggttaattacgataccgctacctggaataagattgaagaagtattcaaaagcaataatttcggcagcatcaatgaaattactagagcacagatagtagatgacttgttcagtcttgccaacataggagaaataagttattcgagggttttgaagtttttggagttcctgtctgaagaaacatcgtattttacatggacgtcagcttttaatggttttcaatttctctttaacagacttcagaatcagtccaatttaaccgagactgttacgagtaatgttttgtctctcatggataaattgtacaaatctacaccatttgatgttatagatgacgataaccaagttttcactcttaaaaaaatgttgacacttagttgggcttgccaattgggccatcctgagtgtctcgtcatgtcacgtgcttcattcttatcctataaattgagtggagtaaaaccacaaaagaacttgcgcagtacaatatattgtacagctctgcagacaagctcagaaagagaaaattgggactttttgcttaaggttcataacgaagccgaccttgactctgagcgccctcttttgctcaaatctttagcttgtacacaaaataaagagcttctacaagaattgttgttgttgactattgctgacgattctccgattgctcgagaagattgtataacagttctgggtagtgttgctgctaattcaaacggagctgaacaagcgtttgattttgtaattaataactacgataatataactcaaaggtaccaagctacgaatacaatagcgaatattttggaaataatcggtggtgctattacaactgaagaacaagtggacaagttccgatctttcatcaatggtggtcaattaccaaaagactatgttaacgatggcgaaagagcactggaaattgcacagaaaaaccttaactggtcggaaaaacacgaaaaagatctaattaatcattactatccagagtcaaaggaaccagacgaacctcaaccatatacaggagagggagtttctataggttcgaatggtttgatcattggttttatagtatcatatttattattg

SEQ ID NO: 62 - DNA, 2604 bp, Diabrotica virgifera virgifera
atggaaaaaaacaattgcgaaaaaaattgcaatagagaccaattggcaaagtacagattgccggacactgtcaagcctttgctatatgatctctatctttatccagatctaaagaccggactatttacaggaaaagtaaatatctctttggagattttaaaagaaacagagagcgtgagcttacactcaaaggggctcaatattgcaaatgtgaaggttgcctcccagccaggaatatttaccatagaaaagacctacgatttactcaacatcaaaagacaagataattctaaatttatacctggatttgataatgttgagattgagtttaatggtgatatgaaaaacagaattgtggggttatataccagcagctatacaacatcatcaggagagaaaaggcaaattgcaaccagtaagtttgagccaacattcgccagacaagcctacccctgctttgacgagcccaatttaaaagccaaatacaaagtccatttattgaaaccaaaggatagctcctacatagctctatctaattatcctgtagagaatgtaacagattacgataacgaccaccaactagtcactttcgatgaaactgtatcaatgtcgacgtacctgtcatgttttatcgtttccgattttacacataccgaaacatccttcaacaacagcggaaaaattgtaccccttaaagtgttcgctagccctgaaaatttggataaaacaagatatgcaggagaagtaggaaaaaaagtcattgaatattatgtacagtattttcaaatgccttatcctctgccaaaattggatctggttgctattcctgattttgtgtcaggcgctatggaacactggggtcttgtcactttcagggaaacggcccttctgtatacaaatacaacgcattcaagtctcaataaacaaagagtggcaactgtagtggcccatgaattagctcatagttggtttggaaatctagtcacgatgaattggtggaatgatttgtggttaaatgaaggatttgcctcttacattgaatacaaaggagtattagcagcagaacctacttggggcatgcttgaacaatttattataaccgatttgcatcctgtattatcatttgatgccaaactaagttcacatcctattgttaaacatgttgtaacgccagatcaaattactgagatatttgatgttatctcttacaataagggagcatctatcttgcgaatgctggaagccacagtaggcgacgaagttttccaaaatggcgtcaaaaactacttaaataggtacgcatttggcaacgccgtcacgaaagacttattaagcgaattgcagcttctagtcggaaataaattggatgtcacagagatgatggacacgtttacacttcagatgggttatcctatattagatgttgccatatcgggcgatacttacactttgactcagaagaggtttttaaaggatcctaatgctgtttataatgttaacgaaaccaagtataagtataggtggtctgtaccagtgacttacgttacaaatttgggcaagtctagcgaattcatactttttaaatacagtgataatcaggttaccataaagaaaccagctggagcaacatggctgaaattcaataccgaccaaataggttactaccgagtcaactatccactcgatgaatggcaaaatataataaacaactataaattgtttagtaccggagacaggacccatcttctagaagaaactttctgtatagccgaagccaatcaattaaattatacaattccactggaactgactaaaaagttgaaagacgaaatcgattttactccgtggagtgtagctacatccaatttaaaagatattcttgctaggcttagaggcgctaagtcagatatgatctcggcatacaaggaatatattacaaagattgtttcacctgcttacaataaatttacttggacagaagatgcaagtgataagcaccttgaaaagttagcaagactcagagtacttagtctagcctgttcagctgatcataaggaagcattggaagaagcgcgctcaaaatttaatacctggatagaaactaaacagccaatatcaccaaatttacgaagtcttgtatatgtttacggaattaagaatgcttctgaaagtgattgggataatatgttgcaagtatatatgaatgaaactgatgcttcagagaaagtaaaacttatggatggtttgtcaagtgtggacaatgttaatttgctgaaaaaattgttggatttggttaaaaacgaatcagtggtaagaagtcaagactacctcatagttttaggaactatttcaatcaatcccaaaggaactgacctggtttgggattttgttaggtcaaattgggactatttagtaggaaggtacaccttaaatgagagaaacttgggcaatctgatacctagaattaccaacaacttctatactcctgataggttacaagagattgaagacttctttaagaaatatccagaagctggagctggggcaattaaaagaaaagaggctttagaaaccgtacggaataatattctatgggtgtcgaat

SEQ ID NO: 63 - DNA, 1674 bp, Diabrotica virgifera virgifera
gcaacgtacatggctagcttggccctcgaagatctatttccacaatggaattctctagaggaagaagatgctgataatatattggacgttttctcgtttgatgcactaaggacttctcatccggtatcagtaccaatcggaaaccccaaagaaatcgatgaaattttcgacacaatttcctacaaaaagggatcatccctgataagaatgatgactctcttccttggagaagagatattgagaaaaggagtcagcaactacctcaaaaaacacaaatacggaaatgccgaacaggatgatttatgggaggctctaactaaggaggctcacagtcaaaatgtgcttcctaaaaatttaaccgttaaacttatcatggacacgtggactgtacagacggggtatccggttattaatgtaatgagggattactcaaagaaatcggcttctatttctcagcatcgccaccttagagacataatatacccgaaagacgcttctaaaccatgttggtgggtacctttaagttattcaaccaaatcaaaccccaattttaattctacaactccaaaacattggctttcttgtccagaacatagtcaaactatagaagatttgggcgatgaaaacgattgggtaattttcaacaataaaatggcaggaatatacaaggtaaactacgatgagagaaactggaacatgatcacgaagttcttgcagggtcccgactttcaaacgatcccaactttaaacagagttcagatcattagcgatgctgcagatttagcttacattggaagtctcaaatacgagatctttttcgagatgttgaagtatcttaagaaggaaactgagtatatgccttggaaagctgctatagataagactgatgtcatcaccaagcatttgaagaagtctgcatcgtacggaaaatacaaggaatacatgagacatttgttaacacccatttatgaaaaattcggaggattcgaagtgaccaccgatccagaaaaattggattatatcaaattgcaagcattgattgtcagcagatcctgtgcatttgaagttgcaaattgcgtatcacaagcaaaatctctctttaataaacttaaagaaaaacaatctgataatgtaattcccaaagatctaagaagtgccgtttactgtaccgttttaaaacatggcggcgaggcagaatgggacttcctctggaacaagtaccaaaactctaacgtagcaacagaaaaaagtaccattttaaccaatctcggttgtaccgaagaaatatggatgcttgcaagatacttagattggtcattgaatgacacccagatcagaagacaagacagtagttcagtattcgcctccgtttcaagaaataatgtgggatacttcattgcgaagaattacttctataataatatcgataaagtctataaacatttactgacaaataaaaagacactgtcgagatatttatcagctctgtcaaaccaaattaccgatgccaaagacgaaaaagaattcgaacgcttcatcaaaggcaacaagaagaccttcgccgaagtcaaaaagggcgtcgaacaatccctagaaaccgtcaaaatcaacatacaatggcagcacacgcacgctgaggaaatagctgacatcttgaacaaatattccaaataa

SEQ ID NO: 64 - DNA, 2037 bp, Diabrotica virgifera virgifera
atgtggtctagtaaaatcagcagaacttccttcacgactctcgatatttaccgaagaataactcgaggagtaactaatctagcaaaatcgagacaagcatctacctccgatatacatttgtttaaagttggagaaaagtatcacggattcgaagcaaaacgcatagcaagtattcccgagctgaaaacgaccgccttgtacttattacacgagaagaccaaagcccagtacctgcatttatataggaatgattcgaataatgtattttctgtcaatttacgaacgacaccgatgaatagcactggtttgccgcacattttagagcacaccgtgttatgtggatcggaaatatttcctgtacgtgatccgttttttaaaatgttaaacagatctttagctacgtttatgaatgctatgactggacctgattatacaatgtatcccttcagcacgttaaactatacggattacctaaacttgcaaaaagtttatctagatgcagtatttagaccacaactaaaggaactcgattttatgcaggagggttggagactcgaaaacgttgatccgaatgatgtaaacagcgatattattatcaaaggaattgtttacaacgagatgaagggagtttttgcttcaaacgactcgatacttggccaaaaactacaaaatcttattctaccttctcatacctacggagttatatccggtggagacccacaagaaataccaaaccttacttggaacgatttgaagaacttccacaagcaacattaccatccgagtaatagcagacttttttcttacggaaactttccactattaccttcattggaatacattgataaagaatatttaagcaaatatgcatactcacccccgacacatacagtagtgcccaaggagaagagatgggaggccgcaaaaagagaacacataaaatgccgttatgatgttttgggcgcccctttcgaaaagcagaatacaatttcaatatcggtgttagcttctgacactacggacgcttatcaaacattagtagttgacttcttgacaaatctattgataaaaggaccgaacgctcctttttatcaaagtatgatcgagcctaatatttctgggggattcactgctagcactggctttgataatcaacctcgagatggaatggttacaataggtttacagtctgttaaaaaagaagattttgataaagtgatatctattttcgaacaaacagtggataaggttatagaaaaaggatttgaaccccatcacattgaaatggttttgcacagttacgaactgtccttggctcacgaaagtagcaactatggtttaggtctcttatttggtatttctacggcttggaatcacactgaaaacataatagaacatttacaaagtaggaaatggatagacagattgaaacaagacattaaaacaaatccgaattttttgcaagacaacgttagaaagattttcaaagataaccaacataaacttatattgacaatgtctgcagacaaagattttgaagctgaattagccaaagcagaaaaccagctgattaagcaaaagaccaaaggtttgtctagtaaagataagaaagttattcatgaaaaagcattagaactacaaaaacaacagatggaacctacaagaactgaacttttaccaactttgttaattgacgatattagttctgatgtagaaaaagttgatatggaaaaagtctctttgaacaacgtacccacccaaatcaacaaagtgaattcaaatggaatagtgtattttaaagcaatgctcaacacaaattatttgtctccagatcaacagatgcttctacctttattctgcttcactattagtaaattaggtactgacaagcttaactacaaagagttcgatagtctgataaatagaaagacaggtggtttgacattgaacagtcatattggagaaagtttatacagcttgcacacttaccaaccgagtctacttcttagcagttacgctttagaaagaaacgttgaa

SEQ ID NO: 65 - DNA, 2088 bp, Diabrotica virgifera virgifera
atgtttaagtattattttgtagtgttgtgtttttcgttatattttgctgttggatgttttgaatgtttaacctatcggctcaatccatcagaagctgtgccaataacctacgaaatcgtaatcaaacctgatttagataatgatgtatttcatggagaagtcatcatttatgtagtgactaaaataagcttaaatggtattacattacatagcgatgaacttaatataactgatgtttatattaaccaaataaaaggttgttatgtagaagaaacagaagaaagaataacagtcaaatataataatggtcctttacaaccgggagagcacacactgttgtttaagtattctggaaaaattcgaccctcacatggtctaataaaagctttatatgaatataaagatactaaagaatacgtttatgtcacggatttggaaccgaacaaggccaggcgagtatttccctgctttgacgaacctcaatttaaagctaagtaccatattaagctggtatcaccaaacgaaacttatgcggctatttcaaatatgcctgaaattaccaaattccgcacctcgtatggaattgttcatgaatttgcagcctcggttccgatgtcaacatacctggtatcttttgcttttactaattttccttactacagtgaaaatttcgaataccaaggaagacagattccaataagaatattcacggtcaacgcaagtaaagaaaataacgagtttgctatgcaatgtgtcaaaactgcattgtctttttattcggattatacggacattagctacccactacccaaattagatatgattgaatacaaacgagaggaaagtgcagctacagaaaattggggattaattacttttaggcagggtctgcttactacgccgttacgtatttacagcaaatttcaaataaaactggtggcgttccacgaattaagtcatttttggtttggaaatttggtaacgaacgcatggtggaatgatatctggctacaagaaggatttgcaacttatatgagctataaattatcagcacaggataataataatacgcagcttgatgagatgaaatcttataactttaacgaattctttgaaacagaaatttatgagaagagccagccaatcgttcaatatttaccagacccaagtaaaattgctgatgtttttaacggccttgtgtacgaaaaggcttcggcgattcttttaatgttggaggacgaaattggtcaggaaaaattcaaagaaataatcaggacatttctaaagaaatacgcatatcatacagctactacaaatgattttattacagtcgtagaagaagtggtgtcagacatacctctaagaacgtttttggagagttatttgtaccaaaataaatttccagttctcaacgtcgatattgtaaataactcgacgtatgttataacacaacaaatttgcgagacggttcaacaagaaccaattagtgctactaaatggacgattccaattagttaccaaactgattattctaatgattcaaaacatgtatggtttcacagagaaatggaagaattaagacttgaggaagctgatgcgaaatggatcatttttaatcccgaagggaaccaaatgtataaagctatatggtcaactaatatatggaacaaaatcatcagcaactttgatttaatggattattctactacagacacggttatttcggacgcctattattcattccgattcaataaaatcaaatgtgaaatagtaatacacctcatggaacaattaaaaccagaacacaagagaaaatggatacttttctacgcattctacgatcaccttaaagaaaacctcttctgtcataaatatactgaagaagcgacacttttctggaaattcctgaagagaagattttctgaaacaaattatccaaaaacgcctaaattaagaaaacctgaatcatgcgataatcaatacataattcaaaatgaagactaccgaaaaaatttagaccagtgcgcgacatggattagagaaaatctaaaagagaaagattcgaacgcaatcaagacaattctttga

SEQ ID NO: 66 - DNA, 1833 bp, Diabrotica virgifera virgifera
atggtaaaagcaggcctaagtccttgtgatcctagttcattttctagaccagatcaagtcattgttactgaattatttttgaatttggatgttaattttgaatcaaaaacattacatggacatgctattctttctataaataaaattgatgaaacagctacagaactggtacttgacacatttaaattgaatataacgtcgatatttgacgctgataaaaattgtacagaaaaattagaatatacattatcagatcacttagaagattttggatcaaaattaacaattcagttgccccaaaaagaagttaaaaaaattcatatcgagtatgaaactgcccccgacgctagtggtcttcaatggctccagccacaaacaaccgcaggaaaaatacacccatttttatttagccaatttcaaccaacacatgcaagatctgtgataccttgccaagatactccagctgttaaacatccttacagagctacaatttctgccccaaaggaattggaagtgttaatgtcggctatcaatgaaggatccaaggtgattggcgacaagaagcaatattctttttaccagcagattccagtgccttcttaccttatagcccttgctgtaggtgctcttgaatctaggcgtttgggacccagatcacacgtttgggcagaaaaagaactgatcgaggagagtgcctatgaatttgctgaaacagaacatcaacttaagactgctgaagatatttgtggaccatatgtgtggggtatatatgatcttctggtcttacctcccagttttccatatggaggaatggaaaacccttgtttaacttttgttacgcccactttattggctggcgatagatctttagctaatgtaatagctcatgaaatatcacacagttggacaggaaatctggtaacgaacaaaaccttcgagcatttctggttaaatgagggttttacaatgttggttgagaggaaaattattagtagattggtatcaccacaaatgcaagactttgacgcctacacgggcataagtgatttaaaagaagctatagaagtgttgggcgctgatagtcctttaactaatcttatagtagatttaaaaggagtccatccagatgaagcattttcaacagtcccatatgaaaagggtcaaacattccttaggtatttagaaaaaactgttggtggtccagataagttcgagccgtttttaagatcctactttgataccttcaaatacaaatctattgacaccacagattttaaaaacttttttgaaaattactttgaaagtgaacctgaaatcaaaaatatcgattgggacaaatggttgcataccccaggaatgcctttaaccattccagattacgatacttccttggctgaagcctgtgatcaactcttggagaaattttacaattggacgggagaaggttctttgccaatatctgctgaagacaagcaacaacttataccagaacaactaatatactttttgcagaaactgtcagaagctgagtcgcaaccaattccaaaacttgttgctttaaatgaactgtttggttttgatggtgttaaaaattcagaaattaaattccgttggctgaaaactggcattaaggccaaatgggaagtacaaattcaaaacgctttagattgggtgaatgtggttggtagaatgaaatttgtaaaacctttatatagagaattattccaatgggaggttagtcgaaatagagctattgaaaattttaaatctaatagacataatatgatgcatgtttgtgcaactactcttgctaaagaattaaaaattgaatag

SEQ ID NO: 67 - DNA, 1892 bp, Diabrotica virgifera virgifera
gaacttaaacaagagtattatagattagtaacagcccaagtcaaatcatcggaacagtttgaagtcgctgaaaagaagaaagtggtaagagctattagcttggcagaaagtagcacaggctctgaccataacatagaggctacaaaagaagataatgaagacgattttaatgaaaataaagacgtttccgtttttgaaatattaaagatgaatgctccagaatggccttacattttatttgctggtcttggatcaattgttgttggttgtggaatgcccgtttttgcagtcttgtttggtagcattttggggacattagcaaatggtgatcctgactttgtaagatctgaaaccaacaaatattgcttatattttgtgctgggaggactcataactatggtatcagtatttactcagatgtacctgttaggaattgctggtgaaaaaatgacagaaagagttaggagtcgattattcaaggcaatgatataccaggaaataggcttctttgacaagaaaacaaatggggttggagcgctttgtgccaaattgtcttctgatgcttctaatattcaaggggcaacaggaattcgggttggaaccattcttcaatcaatagccacattttgcttagcaattggtctttccatgtattatgaatggaaattgggtttagttacagcagctttcacacctgttattttgatcgctatgttctttgaaagaagaaacaccagaggtggaaacgattcaagagattccgcactacaaaaatcaacaaggactgcagtagaagccgttgggaatatacgaacagttgcctccttaggcttagaagaaagttccagcagctatatgaatctgagctcatgccacattataaatcttcgttaaaaacagttcactggagagcaatcgtgtttggtctttccagaagtttgttgttctttgcttatgctaccgcaatgtactacggcggatttttgataagggatggattgccatacgatagagtatttaaggtatctcaagcacaaattatgggtacagtttcaattgccaactcactggcattttctccaaactttgctaagggtgttgcagcagcaaaaaaagttaaaagcttcctttcaagaattccacttattcgtgatttaccttcttcacgacaaatggttaaggcaagtggcaacttcagtttttcagaaatcgaatttacgtatccaacacgacccaacgtactaattttaaaaggacttaatttggacattctaaatggaaaaactgtagctctagtgggagaaagtggttgcggaaaatctacgataattcaactcatcgagagattttacgatcctagatctggtgaagtaaaaatggatggtgtagatttaaaagatatatcactagattcgttgaggtcgcatatgggtatcgtatcacaagaaccaaatctgttcaataagtctattgctgaaaatattgcttatggagataattcaagggaggtttctatggatgagataattaaagctgctaaaaatgccaatattcataattttataactggattaccgaagggatatgaaacaaaactaggagaaaaggctgttcagttgtctggtggacaaaaacaaagaattgctattgccagagcattagtaagaaatccaaaagttttacttcttgatgaagccacatctgcactggacactgaaagtgaaaaggttgtccaagaagcattaaatgaagcgaaaaaaggaaggacgtgtattacgattgcccacagattaacaaccatacaagatgcagacttgatatgcgtagtcgcaaatggtgtaattgctgaatctggaagccatcaagaacttctgcaaaaggagggactgtac

SEQ ID NO: 68 - DNA, 1752 bp, Diabrotica virgifera virgifera
ctgtttggcatgaagtcggtaggcgttgggataggcgttattttaactacctatatatcaacggtcctttttatttacagcgcatctagacagatcttcaaaatcagaaaagcttttcttgagaaaacgcttaatcaagatattgcgtggtttgaccagaatcgtactggagactttgcaagtacattcacacaaaacatttcaaaattagaagagggaattggtgagaaaattggaacttttctattttttgagtcaacctttgtagcaggatgtgttttgggtctagttaaaggatggaaattagcattggtgtgcatggtatcccttcctttatcgactacaattatgacaataatatcatggatatctacaaaattttcagcgcaagaaatggaatcatacggagaagctggtaccatcgctgaagaggtcttcaccgcaatcaaaactgttgttgcttttgatggacaagacaaagaaattgaaagatataataaacacctcgttgatgccaaaaagaataacttaaaacgtagcttttttactgctgtaagtaatggatgcttatggtttttcgtatacgcgtgctacgctttgtcgttttggtatggagtaacattaatactgaatgacagacatcttccagaacacgaacaagtttatacaccggcaaatatggtatctgtgttcttttcaacgttaatagctacttggaattttggattaggagctccactactggagacttttggaacagccaaaggggcagcacaaaaaatatttttcgtattagatagcaaacctgttatcagaaaatttgcaaacagtggaattgtaataaatgatgccgctttggaagtaacatttgaagatgtgcattttagttatccttcaagatcagatgtaaagattcttagaggtataaatcttacaataagtaaaggtgagacagttgcattagttggaaaatctggatgtggtaaatctacctgtattcaattacttcagaggttttacgatccagatatgggtcaaataaagataaatggtatagatattaagcagctaaatttagactggcttaaacaaaagatttccgttgtaagtcaagagccagatttattttccactaccatcgccgaaaacataagatatggaaaactaaatgctactcaacaagaaatagagaatgcagcgaagaaagctgacatccacacatttatacagactttgccgcggggttaccaaacggttctaggagaacgaggaactcagttatctggtggccagaaacaaaagatagccatagctagagctctagtacgaactcccgagtttctacttctagatgaagcgacttcagctctcgatacgacaagtgaggcagaaatacaagaggctttagattcaatacgaggaacctgtacaataataatagttgcacatcggctatcaactatacgacaagcaagtaaaatcgtggtaatcaatgaaggaaaggttttagaaatgggcacacatactgaactaatggatatgaaaggagcttatcacaatctagtaatttctcaaggactaactgaaactttagaagaaaaaggtaatagacgacggagcaggaaattcagtgaagctaacaagtctataaatgaaaaagaagacgaagaacttgaagatacacagattaatcaaccagttgcgaagaacattttatggaaggttttaaaattaaacgcctcagaatggttt

SEQ ID NO: 69 - DNA, 1584 bp, Diabrotica virgifera virgifera
atggtgtctacgaaaaactttgtgattctgatcattgcgactgtggttcaccaaatccgtccagttatcaatataaaagaaggtcaaaatttctggaaacaacgaggttatctagaattagatgaagcaattaataagaaaattatcgatggtccagccaacaatgttattttgtttgtagctgatggtatggggatgacaacgatgactagctctagaatctacggaaaaggagaacaaggttctttggcgtgggaaaaattcaacaacatcggaatacttaagatttattcagcaaacaagttggtaccagattcttgtagcactgcaactgctctcttttgtggtgtaaaggccaaccataaaactgcaggtgtggatgccaccgtggacgttaatgactgtgatgcagcaatgaaggaagagtctcacttggaaagtataatgacgtgggcacaggcagcagaaaaatctacaggttttgttacgactactagagtaacccacgctacaccaagtgccctctatgctcatatacctaatcgcagttgggaatgtgaaagtaaaataccccagaattcaacaaaatgcaaagatattgccaagcaactcatccaagatatgcctggaaagaaaatacaagtaattatgggaggaggaaggcagtgtcttcaatcgtcagtgcccgattctccagcagatccagtggacacctggtcttgttatagtaaagatggaagggatcttataactgactggaaaaaggataaagaaaaaaatggatatacgtatcaggttgtaaataataacgaggaacttcagaatttagatctgcagaaagaatacactttgggagtattcgcaaatggacatctaaaatatgattacgaaagagacaaaggtcccaaaggaatgccttcattagcgaatatgacggaaaaagctatccaattgctacaaaataacaaaaatggttatgtgctgatggtagaaggcggcatgatcgaccaagctcaccatcgcggccacgcaagaaaagctttaggagaaacaatcggctttagcgacgcaatagaaagagctttggaattgacggatccttccgagacccttattattgtcacaagtgatcattctcattccatgatattaacgggatatccagacagaggacgaggagttctttcttataccaattccgcaatggacaatttaccatttacatctttgttgtatggtacaggtggacctaataattatcaatttgtattggataataacacagcgactcgtattgatccgtctaaaaacaatactggagattgggaatattctcaacaagcattggttcttacagatgaggtaactcatagtggagctgatgtattggtttttgcgagaggtcccatggctcacctattcaactcagttcatgaacaaacctatgtagcatatgttattgcatatgcaactaaaataggaccatatagtgattcaacgaatggatcagtaggtttttcagacttcaaatatatccatgtgataaccatatttcttatagtagctagttttgtgataggtgat

SEQ ID NO: 70 - DNA, 945 bp, Diabrotica virgifera virgifera
aaactaccagtgtcagttgttccaacacattataaaatacaccttttaccagatttgagcgattttacatttaaaggggaagtcagtattaatattgaggtaaaaacttctacgcatgaaattaaattacattcactagatttggagctgaattcaataactttaaaacatgaaggggaacaatatacacctatcgatacaaaattacacactgaggaagaaatggctgtgtttaaatttaagtcttcccttactccgggaaattatactttggatattgcatttagtggaaaattggaagataacatgaaaggattttatagaagtaaacatgtagatgaaaaaggagccgagttttattctgctgtttcccacttcgctccaacagatgcaaggcgctcttttccttgttgggatgagccagctattaaggctacatttgatgtcagcttgaccgtaccaaaacatctcctggcactttctaatatgtctattttaacttcaaagaataaaggagagttaattaagtacactttccatacgtcaccgaaaatgtctacatatttagtagcgtacgctgtgggagaattcgatttcgtggagaaaatatcttcagatggagtgttaataagagtatacacaccattaggtaagaaggaacagggagaatttgccttagatgttgcaacaaaggttttgccttactataagcaatattttgatatcgcttacccgctaccaaaattggacttgattgctgtgggtagcttaggatttagtgcaatggaaaattggggccttattacttatagagaaaatcgtgtattaattgatccccaaaactcatcaaattcaaccaagcagggagtggcgctggtcgttgcccatgagttagctcatcagtggtttggaaatttggtaactatgaagtggtggaccgattta

SEQ ID NO: 71 - DNA, 936 bp, Diabrotica virgifera virgifera
gtaaaccatgccaaaactattgccaacattatcaacggactttactctcccttaaatatttttatagctttagtaggagtagtgatatggaccgaaaacgatgaaattaatttctctcctaatggagatacgacgctcacgaattttctccattatcgaagagagaagcttattaagagtcatcccaacgacaatgctcaattattaacgaaatttaattttgatcatggagttgtgggaaaagcacttaaaggccccatttgtacttacgaattctccggtggggtgaacacggaccattcacctgttgtcggacttgttgctaccaccgtcgcacacgaaatgggccataatttcggtatggaacacgacacgaacgagtgcgaatgcccggacgaccgttgcataatggctccgagcagctctaccgtcgctccgaaacattggtcctcgtgcagtctcaactaccttctgcaagccttcacccacgggatggattactgcctaaaaaacaagcctaaagcgttattcgacagtcccgtttgtgggaacggattcgtagagccgggcgagcagtgcgattgcggcctggaggaacactgtgataattattgctgtaacgccactacgtgcatgttgcatagtaacgctagctgtgcgacaggagagtgctgtgatcttacgacttgcctaccaaaaggtgcgggaactctatgcagatcggctgactacgaatgcgatcttccggaatactgcacaggacagtccgaatactgccccgaagataattacaagctagacacagaagtctgcgatgacggtaaagctttctgttaccatggtttctgcagcaccagatccgaccagtgcaaactgctgtggggagagacggggaaatccagcgacgaccagtgctacatgatgaacaccaaaggc

SEQ ID NO: 72 - DNA, 852 bp, Diabrotica virgifera virgifera
gctcatgagattggacataattttggttcaccgcatgactaccctccagaatgccgtcctgggggccccaatggtaactacattatgttcgcctccgccaccagcggtgatcgacccaacaacagcaaattttccagctgtagtgtcggcaatatcagcaacgttctagacgcgatcgaagagaagaagaaaagaaattgtttcactgcttccgctggtgccttctgcggtaataaaattgtggaagccggagaggaatgcgattgcgggtatgatgataaagaatgcaacgaccaatgttgctaccctagagttatcagtgtaagggataaggaacttaatagatcagccgttgggtgtacgagacgtgctggcactgaatgcagtcctagccaaggtccatgctgcagcggcgaatgcaagtttatatcttcgtatcggcaggaagtgtgcaaaatggaatccgattgttcccgatcgtcgaaatgtaacggttccagcgcagaatgccccgtgcctactcctcgcgcagataagactcggtgcaacaatggaacccaattgtgcatcaagggagaatgctccggctcgatctgcttagaatggaatttagaagcttgttctttgacaacacaagatcatcccaatatcgataagagaaagttgtgtgagttggcttgtcaaaatggcactgatatttgcagaagtaccagtgagtttgccgatagagtaggacttcctcctggaggcatcagtttaagaccgggttctccttgtgataatttccagggatattgcgacgtatttcttaaatgtgcaccagttcaggaacctatacttcgtctaacctaa

SEQ ID NO: 73 - DNA, 905 bp, Diabrotica virgifera virgifera
ccattggatcatttaaatctaaatcaagcaggttactatagagttaattacgatgacgtttgtggactagaatcattaatacattacatggacaagataaaaacaaaatacctgtgttaaatagagcacaactcatcgacgacatattttctctagctagagctggcaaagtcgattataagaaggcttttgaactactggattatcttaagtatgaaactgagtattatccttgggcctcagctttaagaacaacatcgcacatactagaacacgttaatgataaaacaaaagtgctactaaagtcaaaactcttaacactaataaatgcagcttttccatctgttactgaaataaaaagctccaaacacgtagatattttaaaggaacatttgatattgcattggaaatgttttctagatgataataactgcttgaatagtgccaaagtaaaatttgaggaattcaaaaattcaaatagtttccagaacaacaacgagagggatataggcctatcctttggagtacgcactagtaataatgtcttttatgattttaacttcctaatgactcactacgaacaattaaaatcgagggtagaacaggaatctatattaagatctttgggctgttttgtcgacgctacgattctggaaaattatctaaaggaaattgtatcagaaaaatcacctattgtatcttacgatgcactgaaagttttcgaatcagtgttgtcacataagcaaggtgtagaagcagctttaaaatttttagaagtaaccaaatcaatcattattaataagtatagtaaaatattgagtttgacggattttattattttattagaaaataaaattacaacgcaagaacaatatgagcagctgaaaaatattgtaactaataat

SEQ ID NO: 74 - DNA, 780 bp, Diabrotica virgifera virgifera
atggctcgtgtcgtagccttatttttaatatttgtgcatgctaccaattgctatcgacttccaaaagatgttccagagaactacaaattagaaatcatttccaacttaggagcaccaaaagatagttttaattttgatggaaaagtatggataacagtaacatgcactcatcccacgcaaaatataactctacattccaaacacttggacatcaaagatgatgacgttatcctgaaagacatcacaagtaacgactctaagaccgttaaaatatccaacgttgaatttaaagaagagttcgagtttttaattttaaatttagaggaagatttgaataccgatcacaaatatgaaatttatattgggttttctggtaaaatggacgacggacttgcaggattttatagaagcagttattacgataagaaagacaaggaaaagaaatggttgggtgttacacaatttgagcccatttctgcaagaatggcgttcccttgtttcgatgaacctgagatgaaagctacctttgacataagtatcggaagaaaagaaggctacacagtaatcagtaatatgcctgtgcttaggactgaaccattgaaagaaaaagacggctggttttgggatcgtttcgacacctcagtaccaatgtcaacgtatctagttgcttgggttgtatcagacttcgactataaatctggaaaattggtagaaaacaacaacgttacctttaggatctgggccagaaaagatgcaataaatcaagtagatttcgctaca

SEQ ID NO: 75 - DNA, 882 bp, Diabrotica virgifera virgifera
tggggaaacaccgaaccattggactacgagcgttcacacaatcatatcttgtcagtcatcgcgtatgattgcggtatgcgacaaagtttcccggcccttgtgacgatcaaggtcaacagagtatgcagactcggatggagaggattaccggaaagggtggactatgctcctatgactggaaaacaggaattgttcccatctgctaatttagaattgtgcgatgtaccttgcactattagagaattgaggactagagtcgatctagctacaagacacatcggaaaaggttgcgacagggacacttactcggttcagtcacaaaggaaattatgtggcgcttctccctctgccatcgatcttctgccaaatcccggagtaggtgctgaatggacaaaaccactcatttcggacgagggtcatgagagcgatcagatgtttgagtttgacggtgccactactgcggtaacaatcccaacatctgtactagagcaccagttgccaactacatttaccatatccacatggatgagacacggacaacatcctacccaggacaaacacttgaaagagcacattttctgcactgctgatgatcacaaaatgaatagacaccactatgctctcttcgtccgtaactgtagattgatccttctcttaaggcgagatttctcagaaggagacctcaacatctttaggcctgctgaatggagatggaagatttcacaagtttgcgacgaccaatggcatcatttcgctatcaacgtccgtttccctgacattcaactctatattgatggacagttgttcagagccgaaaagaagaatcctgaagtaatcgacgattggcctcttcaccccaccaaaggaatcaatactactctt

SEQ ID NO: 76 - DNA, 789 bp, Diabrotica virgifera virgifera
gaagaactgagagaaatcattagcaactatgaatactctggattatacgacaatttcctactcaaacttgtaacgccaatgtacaacgaactaggaacggacactagagtttttgatacccaaaatgaaaaattgttacggttgcatatagttatctcggcgtgtaaattgagatacggtaaatgtattacttgggcaaggaatatattctatcaatggatgaaagaagaggatcctgatgcagagaatccaattccagttgactatcggttcatagcgcaatgtgctgctattaaatctggtgggcctgttgagtgggatttcctttggaatcgaacacgatatgcgaatatagcgccggtggatctgcaaactgcataccaaagtttagggtgtacgtatgatccttggttgataaatagatatttggagtattccttatctggcaacgttagcttggaatatgtgccctacgtctggcaatccataaaccatcctgtgggagttagaactggtttccaatttctaaggttaaattggaacttaatttataaaacctacgaggaggtttatttagtttttagtacgattttccatgacttccttggacaattctccactgaagctgacctagaagatctgacaacgttttataaaatccatcaaaccgacctgaaaaccatctctacaattctgcaaagtacagttgacagaatcaaagttcgcattaactggaaaacaaagcacttggattcagtagtcaattggttaaagagaaacagatattga

SEQ ID NO: 77 - DNA, 672 bp, Diabrotica virgifera virgifera
atgttcagtgattgtgttgctgtgttattgttgcttctagtcctaccttttattgaaagtgctgaacgactgaacgaatacattcgtcactatgagacccttgcctatgacaccgaagctgtccatagggctcacacacgagcgaaacggtccatcgcctcggacaattacgtccatgtggcattcaaggctcacggtcacgactttcgagtacggctgaaaagggaccttcacgtttttcaggacaaacttgaggtgcagggtccaacgggagaaccgctggacgtcgacacgtcgcacatatatcagggacacattttaggtgaacctgacagtgtagcctttggctcaatcattgaaggcgtttttgaagggaagctcatgttgccaagtaagggtgcattttacgtagaaaaggcccatcattattttcctcatacgacacatccgaacagaacattccatagtgttatctaccatgaagaccacgttgaggatccttatgctcacaaaagagaaggtcattctgctggctgtggaatcaatgacgatgtgatcgagtggatgaacaaaatccagtcgtcaggagaagacctgcccattaccccctctacggttgctttcaaaaaagccgtcaaacacaaaaaacatttaaaaaccaaaaaagacaag

SEQ ID NO: 78 - DNA, 465 bp, Diabrotica virgifera virgifera
atggaaatgaccaaagagaaatataatcccaatccacgggagaaagcgaatattttatcgactctattttttggatatacatatgatgtgtttaaaaagggcttatcgaaaactctagaagttgacgatttatataatccattaaagatcgatcgaagcaaaatattgggagatcatttacaaagcaactgggacaagcaactagaaaaagccaagaaaacaaactcaaaaccaagtttactgaaagccattcttatgacatattggttagagtatttgaagttaggaatattcgacataacaacagatttagtccttagactcatccaaccattaatgcttggaaagctgttggaccattttaaacctgaagcacaagtttcaaaaaatgaggcactcatgtatgcaggaatcatagtggctataaacgtattgaactttttgatcggaaatcagtatatggta

SEQ ID NO: 79 - DNA, 652 bp, Diabrotica virgifera virgifera
atgaggacgaaattagtgatttttctgtgtttggtattgtttgtgacaagtgtatacaatgaggatataccagtgaattctttattagatgagctgcatcctgctgcggaattcagccgacatacactcgtgaaacccaaactctaccatggaagagaaaaaagacaaatttcgtcgacgaaagagaagtcgggaaaacacactgatcatctacaaatcacgatggaagtggatggagaggacatgatattagatttgaccattaacaaagatttaattcctgaaggatttttccacaaacatcaaaaaaaacggagattacaaaattcatcaaccaacatttcaggaagctaatatctgtgaatacaatggaaaagttcgtggaaagcctaattcctgggtggccctttcgacctgcgacggcctctctggcgtagtattcgacggcgaagagatgcactacgtcgaaaaaggaaattcgataggcgacgtagaggccgatcattttttatataaatattccgatttattggaacacaataagacgtgcgggtatgccggggatgcggtggatcccgaaaaagctgttcatgctcataacaataatagaatattaaggtataagagagatacagacgaacaattagtcagg

SEQ ID NO: 80 - DNA, 567 bp, Diabrotica virgifera virgifera
agactgaatgtatctataattcctcaagagcccgttttattttcggaatcagttagatacaatttagatccatttgaaaaatacagcgatgaaatactttggaaggcaatagaaagcgttgaactaaaacatgccattactgatttaaatcaaactgtcagcgaaggaggttcaaactttagtgcaggtcaaagacaactcctttgtcttgcaagagctatagtacgaaacaataaggttcttgttatggatgaagctactgccaatgtagacccaggcactgatgccctaatccagaaaacaatccgtgagaggtttagagactgtactgtacttaccatcgcccatcgacttaatactgttatggattcagaccgcgtgctggtaatggatgccggagaagcagtagaatttgaccatccttttaaacttctacaaaacccagacggatattttagtagaatgcttagagagacgggaccagctatggaagaaatgttgaaggcagtggcagaggaagattataataagaagtacggcggaataaaggggaaaaagggggaatag

SEQ ID NO: 81 - DNA, 330 bp, Diabrotica virgifera virgifera
tgcatgtcagtctcgagcttaaaaaaacaaggaccccactgccccgacgactgcaacggcaatggctggtgcaacaacaaaggccactgccactgcaaagacggcttcgctccccccacttgcgactatcccggacctggcggctccctggacagcggccctgcagcggatcctaatggtcagtatcttgagaaaaagatttgtgagatcactaacaaagctgccgaaaaatacttgcgatctggcatcaatattaaatgtctcattccgttttgttgtccgccgaaacatcctattagaaatcttattttaaaggatttgggtgattaa

SEQ ID NO: 82 - DNA, 493 bp, Diabrotica virgifera virgifera
catagcgatgaaattctatggaaagcgttggaaaatgtatgtggaacttaaaggggttgttacagatctaaatcaacctgttagtgaaggaggttccaattttagcgcaggacaaagacaactcatatgtcttgcaagagccatagtacgaaataataaaattcttgtcatggatgaagctacagcaaacgtggatccgcaaactgatgctctgatccaaaaaacaattcgtgagagatttagagattgtacagtactaactgttgcacatcgattgaacactattatggattctgatcgagttcttgtcatggatgccggccaagctgtagaattcgatcacgcctaccgactattacagaattcagatgggtattttgctaagtttctgaaagatgctggaccaccaatggcaaataagttaagagatattgctaaggaggattattataaaaaacacacgtcgccagaagttattgtcgatgacgattaa

SEQ ID NO: 83 - DNA, 537 bp, Diabrotica virgifera virgifera
gacgaaaacaaaaatacctgttcgctgtacatacagacagatcctcttatttggaggcatatcagagaaggattccctgagcatctagatcctaaaaaacaacaagaagtcaacgaaaaaaccagagaagaaatactctctataattgctcatcatgtcactgccgttaactatatatatcgtgataccaagttcgatggaaaaagtgaacatcgtaatatcaaatttgaagtgcaaagaatcaaaattgacgatgattcatcgtgtaggtgttatcacagaggttgtggagaaatgaaccaattctgcctagagaatatagacgttagcaatttccttaatatccattcgctgggcaaccatgaagacttttgtctggcatatgtgttcacttatagagactttaccggaggcacgttgggactggcgtgggttgccagtgcttctggtgcttctggaggcatttgtgagaagtataagacttacacggagactatcggtggaatgtatcaatccaccaaaaggtctctaaatacg

SEQ ID NO: 84 - DNA, 531 bp, Diabrotica virgifera virgifera
ttggtggcgtttacgataagcgacatgaagagtatttcagctaacatcacagcaggaccacctgtcaaaatttgggcaccagaaaccgacctcagccaagcacaatatgcactagacgtcataatggaattgttaccgtttatggaggattattttgatatgaagtttcctttacccaagttagatttacttgcaattcctaattttggtaaaactgctatggagaactggggcatcatatcttttagaaaatcttcagtcttatttgatcctaattccactagtattaagaccagaagctatatattagcgaaaattgcgcatgagttggtccatcaatggtttggaaacttggttacgatgcaatggtggtctgacctctggttaaatgaagggcttgccacgttcatatcggaaatagcaattacaacgctaagacctaaatggcatgcttacagtagcataaaagttagggatacctataatacactaaatgacgatagtctcaaatcagcaagaagtatgcagagg

SEQ ID NO: 85 - DNA, 489 bp, Diabrotica virgifera virgifera
atgggtcgtggaggatatcactccaatagggcggagttcctttcagacgaagccattttgaaatatagtcgcaatgggggatgttttgttaccactaaaaaagccataggatttgtagtattcgctctaatctctctattaattgtagtattattaatgtattattatggtccgacaaaaactagtgaaaagataattaaagaatcgaatgatatagaaaagttaataaacgacacaataaacgaagaagcgacgaaagaagctctgcggttaccaaaatcattgtaccctctgcattatagactatgggtccatcccattttagatgaacacagtgagaacaactttacctttactgggcgtgtcatcatagaagtcaagtgcattgaggacacgaataaaatcatacttcacgcagatgatctaaacatttccgaatccgattttaaagtatataccacgagacaggttgaaataactacagagcta

SEQ ID NO: 86 - DNA, 451 bp, Diabrotica virgifera virgifera
gaccacttaaattttggaaaagaaaacagttggggtcttttgcttgaaagagaagagaatctgcttgatgaaggatctaaaaccagcgttaaacgaaaaacaaagaatcatacaaacgctgacaggagagatagctcatcaatggtttggcaactatattaccccagagcggtggtctgatgtttggctcaatgagggttttaccacttttttaaagtatcacctcccggatttaactttacaggaattagagactacaaatcaattttcaatcgaaattcttcaggatgctttgtaccaagattctattcaaggtgaagaagaactttcaactattgaaaacactgccatgaatcctaaaactcaggagagaatgaacaagtttaaagctattaaaggtgccagcattatacgaatgatgcaatctacactgggtagaaaaaatatttga

SEQ ID NO: 87 - DNA, 464 bp, Diabrotica virgifera virgifera
tggactgagcatccttctcggaagaaactagaaaaaccagaagtcctaagttgccttcatcaatgacaaagaaagtttacaggtaccctctatggagctactccaaccaggacatggaattattgaccaactcagacttgaccgaagttaccgtcgaaggagacaaccgcacaaacttggaaactctcgttcgcaaaattggatacgccaatacgagagaattcccgacgcccggccgaaggaatttgcgtctcaccaccacagttacctgcgataacggcaaacaagttaaagttccggatgcacaaacttacgttatggttttgagaccccagacgcctagcattatgttgaacggaaccggaaacatggcaaggaagtacgaagacttcagaatgggcgtacgagttctcgctgatatacatataacaggagaacagaagttagacaaatgccaattgacc

SEQ ID NO: 88 - DNA, 435 bp, Diabrotica virgifera virgifera
gaccattcagccaactacatcagcattggaagtgccctcgaaaggaagttttatctcaacggggagcgacatattttcctcccgggggaatacaccgttgctggaacacaagctttgtatgggagggacaatcatttagagaaaattcggatcccgggaccgataatggagcctatcgttatttatatctactacagaggaaacactttcaatccaggagttgaatacaaatactcgatctggaaacaagtgaaacccattgaagtaaaatactcgtggattctcggtgagtggtctcagtgctccgtcacctgcggtggtggtacccaacaacgagaacctctttgccaagagttggtgctagaaagaatgtcatctgaaatagaacgaccaaatatggtgacgaatattactaaccacaagataagcccgata

SEQ ID NO: 89 - DNA, 358 bp, Diabrotica virgifera virgifera
atgtacagtacaagaatatcactattcgtcagcatcttagcatacgtcctctccggatatgacatctccgccgaaaaaagtcttcgtcattacatcattctacagcgtccttcgacaatctctgacggtgttcttccctcaaggtatcgcgcaggtcgcagaagttagaatatctatccaaagactgaacaaattcatgcaatttgaagagatagatatggtcagagaaaagtttggacgatgttctatgagcagtagtaaaagtttggatttatccaaatctgggaatggagttgagaaatctgagaggaaaggggagctgggagtctttttaaacaatgctactgccaagtggagt

SEQ ID NO: 90 - DNA, 254 bp, Diabrotica virgifera virgifera
atgacagaagaaaaaaaacatagtataaaggataaagagaaaattggtattgatgcccaatttgttaatagtgaagaaccaaaggaaaaattaagaatgtatcttttcctcagatgtttaggtatgcaagtacttatgataaatttttaatggtagtaggacttatatcggcaactggaacaggagtcttacaacccctaaatacgattctctttggtagcctcacaggagatatcattgcatatgctacgtcg

SEQ ID NO: 91 - DNA, 4425 bp, Diabrotica virgifera virgifera
atgggacggttgcactgtttattttgtattttcctatgttttaccgtcatcaacacgcagacaacgaatatacatggattctcggaaaattccgtggatacatttctatcacctcatgggaaaagtgcaaaattcgtgcaccaaaatcacaaacccaaaattgaaaattgtcagaactacaaaccctcggtgaaagaagaacagccaggcggaacgtacgtaacaacggttaccgctatcgatgacgatcctagggagggaggaggaacaattagttacaaactaattcatagagaaggagaacatgttttatttgacatagacaacgttactggtgttttgacaactatccagccatttgatcgggatgaaccagtaaggcagaaggaactttatgtaaccgtacaagcttcagacaacggcaggccaccattagcagatgtctgtacatttacagttaccattaccgacattaatgataatgcgccacagcttgataaactgaaatacgatgcacaagtttctgaagatttaaaagtaggaagtgaagtgatgagagtttttgcttacgacattgatgatggggaaaattcaagattatcgtataacttttcaaacgaaaatgctcaattcacccagtatttcaggatagatcgagatactggcgttgtgtatttaaaggaagctttaacagacaaaaagaatactagatttaacagtgctgtttatgtagccgataatggcgttaacgatcaagaaggccaaaaagattcaaccgctaagatatctataacagtagtagggtctgataaacagcctcccagatttactcaaaaaatgcctgatggaatcttggagatccccgaagattttaaagacttttctaaacatattgtcacagtcgaagcaacgtccaacattgcggatccacaacttgcttttgaattggtgaagggaaagacatatcaaaccaataaagaccaaacgtttcttttggaggcagaaggaaataaagcgcacataaagctagtgcgtccactggattatgaaacagtaacggaatatactctaactattcgagtaaaaaacaaagatttaatggattcttccataaatataccaattaaagtattagatgttaatgatgaaattcctaatttccttgaatttcttaaaggtagtgtcgtggaaaatgacaagccaggtgcacaagcgattcaagtaagagcaatcgataaagacggaactgctgctaacaacattgtgagctatgaactcgttgacaatacagatttgtttgcaataaaccgatctacgggagtaattacgtcgagagtggagtttgatcgtgaaactgtacctctatatcacgtaaacgttaaagcttatgataactctccgtctgctttgtataacacgacattgcctaacattgtaattcagacattccaaatcagtatagaagatcaaaatgacaacaaacctgtatttactcatccaatttatcagttcagtaatattactgagcttgctgataaatcgagtattgttggtgaagtcaaagctttagataatgacacggcttcagttataagttatagtattacaaatggaaatattgacgatgcgtttatgattgaaaattctaccggcagaataagagttaatggaaaactggattacgagaaaatcgaacaatacaacttaaccgttcgcgcatttgatggggcatttgaagattttgcaattgttttaatttccatacttaatgaaaatgacgaacctccagtttttgacgactatatcagagaaattcaaattaaagaggaagaacctatgatatccggatgcgttgttagagtgactgctcatgatccagatattaaagacaggcatgctgatcaacacatagtatatgaggtcgcgaaagaacagaaagattttttgaccgtatctgccgatggatgcgtacaagtaacaaaacctctcgaccgagatccgcctttcggtagcccaacacgacaagtcttcatctatgctcgtgataatgatggaggcacaaattcattgttggccactgcagaaattgaaattattttaatagatataaacgataatgctccctttttaaatgttacagaaattgtttattatgaaaaccaggatccaggttttataggtaacctaagtgccgatgattacgatggtcctgataatggacctccgtttgcttttcgattatcagacactgcttcagatagtattagatcgaaattttccattatcggaaaccagcttttcgctttagaaatgtttgatagagaagagcaaaaatattatgacattgccattgacattacagatagtggagtacctccactaacaggaactagtattcttagagttataatcggagatgtaaatgataatccagctacagacggaaacagcacgatctttgtgtataagtacgtcaatgggccagaaaatttcatggaaatcggacgtgtatatgttacagacctagacgattgggatttaaatgacaaagtctttgttcaagaagataactttgatgaatttgtattaaaccagcataacaacggtatgattctgatgaaaccaacaacggctgagggaacctacgaggttcattacagggtcactgaaacccatgaacccacaatacacgaacatacagttaatgcaatagtcacgattacagttaaagtacttccagaggaagcggttgtaaaatcaggatcaattcgattgagaggaacaactaaggaagaattcatagaaaattcattgaatggaaagagcaaaagagacatattacaccaagaactctccaaaatattaaatacatctttagcgaatgttgatgtatttactgttttaaattcaccccaccagaatagttcgtttgtggatgttcgattttctgctcatggatctccatattatgctccagagaaactcgaaaacaaagttacagatcatcaaatggagcttgaacaaaaattagatgtggaattctacatgatcaacgtaaacgagtgccttaacgaaacaacgtgtggagctgaaaactcatgtacgaacaaattaaacataacacgagaaccagctgtagtgtttactaacagaacatcctttgtcggtgtaaatgcatttattgatcctgtgtgtgccgctttaccaagagatgttatggaatgtttcaacggaggcgtccttatcgaaaacacagcgtgtaattgtcctgcaggatttgaaggaccacattgtgaaatcctagctataggatttacaggaactggttgggctatgtatccatcctttgacgctacaaacaggactgagattatactgcatattttatcacaaactgataatggtttgatattttacaatggacctttaaatataagacaaacttctttgtctaaagattatatatcattagaacttaaagacggatatccattacttcaaatttgcaccggctcaagcactcaagaaatttatctgaaagagcgcattcacaaattgagcgatggatcgttacacaaaataaaaataggatctggatttgacgatatatccctggaagtagacgactgtggaacaacgtgttcaatttggactaataaactacataaaggtgttatccgagcaaatggcccccttcaactgggaggtatgaaaaacagattcaccgatcaagaattcaaacgaatttgggaccatttgccaccgactgccacccgtttctctggttgtattagaaatttgacgtataatgaattttactacaacctcggtgcaccttctgatgcattccaagcgtatcccgactgtaactatgcagtgatgcaagctgtgactttcggtatcgactccaatttcttggttgctattctggtttgtgtagcaattttgataattcttcttctggcagtagttgtacatagacgtaaacacgacaactttaacgaaaaagaaatcgatgatactcgcgaaaacattatcaactacgaagatgaaggtggcggcgaatgtgacaccaactacgacctgtctgttttccatcagaacaacattgtggacgaaaaaccattgatgagagacaaccccgatgtacctgcagatataagtggctttttagataacaagaaagacaactgtgataaagaccccgataatttgccttatgacgacgttcgccattatgcctacgagggagacggaaatagcaccggatccttatcttctctcgcttcatgtacggacgaaggagatttaaagttcaactacttatcaagttttggacccagattcagaaagttagccgacatgtatggagaagatccaagcgatgaagactcacacgatggaaacgaagaatcctggtgctag

SEQ ID NO: 92 - protein, 261 aa, Diabrotica virgifera virgifera
YDEQVFFSVMTGSMNFGIASPYIEAFGISKAAASKIFSVIDHKPTINLSKGNGKTLNVLIGNIQFKDVAFRYPSRKDVPILKGLSLNIKSGDTVALVGSSGCGKSTVIQLLQRLYDADSGEVTIDGKNIKEYDLTWLRSQIGVVGQEPILFGTSILENIRYGKDGVTEEDVIQAAKKANAHNFIKALPNGYNTLVGEKGAQLSGGQKQRIAIARALVRNPTLLLLDEATSALDNTSEAKVQAALDAASVECTTIIVAHRLS

SEQ ID NO: 93 - protein, 261 aa, Diabrotica virgifera virgifera; identical to SEQ ID NO: 92

SEQ ID NO: 94 - protein, 1323 aa, Diabrotica virgifera virgifera
  misc_feature (896)..(896): Xaa can be any naturally occurring amino acid
  misc_feature (1291)..(1291): Xaa can be any naturally occurring amino acid
MEMTKEKYNPNPRETANIISALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPESQVSENEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVXFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKTEXFYSMVAETGRTTAEQLRKIASDSYQKLNALPE

SEQ ID NO: 95 - protein, 1323 aa, Diabrotica virgifera virgifera
MEMTKEKYNPNPRETANILSALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPEAQVSKNEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVVFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKNGVFYSMVAETGRTTAEQLRKIASDSYQKLNALPE

SEQ ID NO: 96 - protein, 1323 aa, Diabrotica virgifera virgifera
  misc_feature (896)..(896): Xaa can be any naturally occurring amino acid
  misc_feature (1308)..(1308): Xaa can be any naturally occurring amino acid
MEMTKEKYNPNPRETANIISALFFGYTYDVFKKGLSKTLEVDDLYNPLKSDRSKVLGDNLQRNWDKQLEKSKKSNSKPSLLKAIVMSFWLEYAKLGIYTITTDLVLRLIQPLILGNLLDYFKPESQVSENEALTYAGILVAINILNILMSNQYMLEVFHSGMRIRASCCAVIYRKSLKLSKTALGETASGKLVNLLSNDVSRFDIVSLFIHQLWMAPVLSLIVMGILYQRTGYAGVVGVVAVFVIVPFQTYTGKLSAIYRKQTAFKTDERVRLMDEIISGIQVIKMYAWEIPFRKIIRIARRNEIKIITKSAYVRATFMALNLFTTRLALFCTLLTVILSNEEITASKVFVVMGYFNVLSMAMSTMFSRGVSEMAEVMVAIRRIRDFLINEEYDPNRTNFAMNGNVNSVDDFKEIISLQNLTVKWNASFSDNALENININISDGQMVGIIGPVGSGKSSLLQTLLGELDITEGSMRVRGQISYASQEPWVFASTVRQNILFGEEYDKKRYHEVIEACSLEKDFEQFPNGDLTLVGDRGSSLSGGQKARINLARAVYREADVYLLDDPLSAVDIHVSKHLYEKCINGYLANRTRILVTHQVHYLKDADNIIILNNGRIEDEGTFNFLANSDNVYAKLLTAEPENVEEKKQDRSKYNRQLSIRSRKDSLASIVSELSIADTLISNDIDFEEEEAEKQLEFDVKDLQEQSSKGKVGGSLLFKYMLAGSNSFAVLICVILYLGTQLAASGVDYWVSYWVNVEEFRSSSESSNSTTPTFIIPSIELTTNNCLYIYGFLLGALFVLAMTRSFFFYKLAMWSSKKLHATIFDNIVTATMRFFDTNPGGRILNRFSKDMGCVDELLPKAILDSSQMLLSMCGSLLLIVVVNPYFLILIGALSVXFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGEITFKDTCLKYFEGGPLVLKHLDLKIQPKEKVGVVGRTGAGKSSLIQALFRLAPIEGSIKIDDIDTKDISLNDLRLKISIIPQDPVLFSGTLRYNLDPFEEYSDEVLYKAIQDVELKDPANVINRLENRVMDRGSNYSVGQRQLICLARAILKNNKVLMLDEATANVDPQTDALIQKTIRRKFSDCTVITVAHRLNTIMDSDKVLVMDAGQISEFDHPHLLLQNKTEFFKSMVCETGRATAEQLXKIASDSYQKLQALPE

SEQ ID NO: 97 - protein, 1323 aa, Diabrotica virgifera virgifera; identical to SEQ ID NO: 96
  misc_feature (896)..(896): Xaa can be any naturally occurring amino acid
  misc_feature (1308)..(1308): Xaa can be any naturally occurring amino acid

SEQ ID NO: 98 - protein, 934 aa, Diabrotica virgifera virgifera; identical to SEQ ID NO: 44

SEQ ID NO: 99 - protein, 935 aa, Diabrotica virgifera virgifera
MWVILLLSILASATTASNPDLASSDTDPDLFPIQRAAEEVEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYTGNNNTQWYIPVTYRLSNSSSYETFWLAPNSSVTILNNLTDKDWLIVNDDSRGYYRVKYCKRLTQRIQSLLNQNHTQISELNRAQILDDSLNLARAGYIKYSEAFELLEYLKNETSYFPWFTTIKNMDYLVTRLGANTELGKRTNAMILDLISQISANISTTKWEEIDQVTTLKLQRVWADACKRGQASCISETKRLFQALRLNKTSVNPNIRDVVYCNALRNSNNIAADWEFLWNRLLISIHPQEDLYILLSLGCTTHKPYLTRLLDATINSTSVIKLQNLYTVWNSVGSASKEGLDLAFEYFVNNYKKIIEYYPDGISLLSQLANRFTTNAEVTKLQQFADRLEKNSTIRAVANSALTTARQNLQFRARIEDDLNDYFKIDNSGSSVTPLGIFMPLLLLSVVFFM

SEQ ID NO: 100 - protein, 998 aa, Diabrotica virgifera virgifera
  misc_feature (199)..(199): Xaa can be any naturally occurring amino acid
MVGKVDYSSVPTSADLENNSNQKKYTVNQNGKQGVVIPRSLCALMAIGALLLAILVGLIVFFLVPRDCHATKSPQALTHQPPQSASVLNINSRGSSSNNDDTKAETTIAPIVTKVEVEQRLPRSIEPTHYRLRILPHFQNSTSEGSVTMTLNVLEDTNEIIFNSRSILIDEHSVSIRSTKPDSSLLEIKEQLYYEKEKXKIVLKEHLRKNEEYQLDLNFNGKLSGHLQGFYRIKYYDEYHRQRLIASTQFSPVDARSAFPCFDEPSFKANFQITIGRPADMLSLSNMPLAQKTPFSTNNSELWSWDEYPETPKMSTYLVAFMVMDFIKGAGDDPRMMFWARPQIAGNSAYAAQIGPKILSFYENYFGIKFPLSKIDIVAVPEFGFSAMENWGLITFREDVLLYDQQSSTNEDKRTTATILAHELAHQWFGNLVTPVFWNDLWLKEGFSNFLVYSGVNYAEPKWMFAEEFMLSENLDAMSEDALQTSRPISFDNIQNTVQIRQLFDPITYRKGAAIVNMISNFLGEKTFKTGLTNFLTKYSYKNADRNDLFASLTEEAHNRQILLPNETVKIIMDTWTERAGYPVIYAYADYEQNTLRLSQKRFLYRMRDEKSSYWVPLSFTTNVKPNYTDTFPKFWLKGEYETVQNVNLSDIKWYLLNLNQTGYFIVNYDERNWMSLVEAIMEVPTSIRAQLISDSMDLARANIISYDIPLRMIAKMAIRDNNIMFVPTAIAFEKLKYLSDILSSTPAFGFFESFHQTIFKESYKKVALEDPFDDYRTRRIRTTVLNWSCRSSETRCAHLSKIQFRQWMVGAKRVEPNLQQIVYCTALREGGQIEWDFAYKKYIEITSPTEKSTLLDALGCTRHTWLLSRYVDKILNDPSIRIQDADRVFQSVANNKFGTQIAFDFLRTNWVALLKHHGDGFNVIAKMVKALGPQMNTEFQLSELIRFRDSIHSNSSSASEAIASTIETVRGNVEWMQKNYHQVEQWLRKNKNNFDTL

SEQ ID NO: 101 - protein, 374 aa, Diabrotica virgifera virgifera
MILILFAFSAILFNGVHSVCLKNSITTASGLHAPKNKSLCSGQLIFEDNFNWLDTSKWDHEQTLTGGGNNEFQWYTDNRRNSYTYNGQLHIKPTFVADEYGEDFLYSGTIDIGAACTGGDNEGCRRTGSPNAIVNPIVSARMRTLHSFSFKYGRVEVNAKIPSGDWLWPAVWMLPTNWEYGNWPASGEIDIMESRGNRQYYAPNGQNVGTATESSTLHWGPTPQFNKQLKTHWEKINYNGGWDNAFHRYQVEWTPEHIKFSCDDQELGTITPPSGGFWEYGDLGPSGLPNPWSGGTRMAPFDKEFHLIINLAIGGAYFNDEFDNKAYKKPWTSTEPYRQGMTKFWQANQKWKPTWNLNSDDSHLKVDYVRVWAL

SEQ ID NO: 102 - protein, 1688 aa, Diabrotica virgifera virgifera
MATRNLCLCMLIWMPLFEGIVGDVAFGIAQIPGGKATVEDLKKGKYLLNMEENNHGGVIPTPLFTITGVDNTDCPNLNVEFTQGMKFKFSINESCIFYAEQTFDYESNERSYNFRISKSVNDEIDIAFSIKNIDDEPPQLGTFKCNFNEQLDYSLDDTPCNTTLHDPDGWLAQEKILIFIDTKDEDIFAIDLRKPLPNDTETDTYVFMYLLKQLNYEDTNFYQFTVQANDSGGNLSPQESAVVNVINIRSRPPKWSKITLFDQFDELTEQDYDIQALDGDTGIHADICYAKLGEDLPDNYINVSTDKTNKKGHIHVNPIDRDKDDLTLYHFNISAYVCDAPDYFTVNTVQYYIIDIDNNPPRIVENVGDDGKNTTFDDDNDHKNVTLSYLENYSRSYNFSTTITDRDTGENAQFTVSLENVEGSTVDYTQPYLIVPDNAYKTGSFIISVKNKTFLDFENDTWKKHSYYVVSNGKKDKSKTDRMLISVSLEDYNDELPIFEKESYTTEINETVANGTQILYTHATDRDAEDFELKMNIVGTYAENRLSIDKDGNIKVKVVNAFDYDVLNSVYFQVTATDKVNHVTRVPVTINILDVNNKAPVINQVDHIQIEENQQNGVVLNVTITATDVDTTANLTATINWEDSKVTKTNGAVVKTDAVIKAMQFLEIENTQTDDGLEMKLKVINNNDDNPDKPDFETFDTLYLSIVVEDRNTDPDFEQNRYTEGQIVINILDVNDNPPYFPPSNDDTRQVQEMSLKGVSVGSIKAVDVDLNSEITYHCTPEYEKFDWVDVNLTTGAITVKNDKQVDADTDKTYYFNYTCWAHDGVFFSKPLDISIYVIDTNNEVPVIDFPNEVHVKEKSLIDTVIKKIVTSDLDRDEPFRTVNCNFASDTDPDCQIEFYIDTNVLKVKRNKTLDRDKGRKTYPCLFECLDNPLNVRSQGQNKANKSFTIILDDINDHAPVLMTKDLQCSENLNKDGEVGEGIIGEDIDDGDNAKIDFSVLSIVDKETKNDIQESFNISKIDSDYVLNDTLKKVHLIAFEDLKGKYGTYEVTLHMHDEGDPMQTTDPDPTLTLTIEKWNYQTPSIIFPENDQTYIVLSDQQPGQPLALFNNTGTSNTLPDFSATDGETKDCSKWDVKFSYTQTNYEDDKIFVIDHIQPCVSQLQVSKHFNSDLVRSKKYKLTITASVKDGAEQEGEAGYSTSANISIVFLNNDAQPIFQNSDWSVSFVEFNTTQPAKPLEEQAEYENTKGGLPIYYHFYSENQTLSKYFEVDETSGDLSVIGNLTYDYDQDISFHIVASNDSQVRMLDPRSSLNVTVNFLPRNRRAPQWKSTKFFGAVMPTFVTGNLIVTAQAHDDDYIDQQRGLTCSISSEINRIGEGLDKIIGEPFYLSTENDAAKIFLDFTVQTTMTGRFEFKIKVEDNRDDYGNGPFESEADTTIFIITKDNTVDFQFYNDIEDVQDRETPMLKIISDIVGYDAYRQNIDTVTNSGLVRTRARLYFIDSKSSRRLQRTKSPADSGFELVNSETILNIVTNVNTFQNLASTLRSEQKLNLDSFETNSKSGNSEAALRAWLIGVSVVLGILVLLLLITLILKTRQLSNRIKKLTTPQFGSQESGLNRMGINAPTTNKHAIEGTNPVYNNNEIKKPKNMNDFDTHSIRSGDSDLVGIENNPEFDYNFNTNEDKTTYL

SEQ ID NO: 103 - protein, 1257 aa, Diabrotica virgifera virgifera
MGTKKDDIKEKKTNALDAKFVKKKENETKIKPISFFGMFKYASKGDKLLMFIGTLSAVITGCLPPINTILFGELAGNAVQYAETLYNATLSQNEQAEAQEKFFDGIKFFALANSMVGVAMLCFSYLSTITFNYSSTKQIFQIRSDYLKSILNQDISWYDQNQTGDFASRMSDDLSKFEDGIGEKVPMFIHFQVLFVAAVGTALAKGWELALISLVAIPASLVSFGVINLLTTKLAKNEMEAYAASGSIAEEVFSLIRTVTAFGGQQKEIDRYKEHLVSARKNNIKRTMIVGIGFGLVYLLLYSSYALSLWYGVKLVLKDRFNPNASYTPANMVTIFFAVLSASLNFGAASTYLEMFAISKAAAAKIFNVIESKPDINLSKSNGAKLDHLKGNIQFKNVKFHYPSRPDIPVLQGLDIEINPGETVALVGSSGCGKSTVVQLIQRFYNAVSGEILVDGTNIQNLDLTWYRNNIGVVGQEPVLFGTTILENIRYGKEEATEEEIIEAAKKANAHAFIKLLPKGYNTLVGERGTQLSGGQKQRIAIARALVRKPTLLLLDEATSALDNASEAKVQEALDLASAECTTIIVAHRLSTIRGANKIIVLLEGTVVEQGTHDELISLTGEYFKLVTAQVASSNQIELSNDETETKGNNEAYEEYNDDYDDISHDEKNEIDDFKNGKKITLFSIMKLNAPEWPYILIAGVGSIVVGWGWPIFAVFFGSVLGTLAKYDTEYIETETTRYCIFFVIAGVICMISVFLQNYLLGIAGEKMTERIRTQMFTAIISQEMGFFDKKSNGVGALCAKLAGDSSSIQGATGQRVGAILQSLSTFGIAIALSMYYQWKLGLLMASFTPLMLVAIFIEKRNTTGLSEAREKSLQKSTKIAVEAVGNIRTVAGLVAEDKFQKSYITELKPHYKAALAAVHWRGLVFGLSRSLGYFAYAAAMYYGGFLIRDGLYYDKVFKVAQAQLMGTISIANSLAFTPNLNRGISAAKRIKSFLSRIPLIRDGPSSKPMNQVDGNIGYSNVEFFYPTRKNIQVLRGLTINIPKGSTVALVGESGCGKSTIIQLIERFYDPSSGDINLDEQNIKHITLSSLRSHLGIVPQEPNLFNKSIAENIAYGDNSRNVPIDEIIQAAKNANIHNFIVGLPNGYDTELGEKATQLSGGQKQRIAIARALVQNPKILLLDEATSALDTESEKVVQAALDEAKKGRTCITIAHRLTTIQDADIIYVIDKGIVVESGTHRELLNKNGFYYKLYTQKH

SEQ ID NO: 104 - protein, 1290 aa, Diabrotica virgifera virgifera
MDTGNKTTKPRNPAENTNPISFLFFFYMFPIFKKTYKYKLTEEELFSPLKEHTSSRLGSKLEKAWKEEYRIHKKTALHRALFRIFGLRYTVLGLIRLFDELLLIVVMPYCIRTLVAYLEAGQTKITKDEALIYAAALVITLLLDAVMQQPNYMGLQHIAMKIRVACSSLIYRKTLRFSREALGNTTVGQLVNLLSNDVSKFDQLFGLTHYAWIGPIQVALGTWLLYREIGVSAFFGMAFLVAFVPLQIWLAKKMSVMRLKTALRTDERVKLMNEIISGIQVIKMYCWEKPFAHVIDLARRSEMRAIRSHSCLLGILYSFEVFVSRTAIFVSIVGYVLLGNYVSADKVFAITAIYNQMRTIITIIFSLSITALAEMHVTIDRIHKLMIFDEREQDSEDGYEKMNGNYQSKLNGLDGMKNGINGNGTAIELIKKVKEPKLMLSGVSAKWLAQSPENNLSDITFNVPPNKMLAIIGPVGSGKSSIINLILKELPVKSGKLEIDGKVSYASQEPWLFAASVRQNILFGEEYDEERYKLVVEVCALKSDFALFPHGDKTLVGEKGKALSGGQKARVNLARCVYKKADIYLLDDPLSAVDANVGKHLYDRCIKQFLSNKICVLVTHQLQYLRNADKIIIMKDGKMEMTGSYTELKKSGLDFAKVMEEFNEEAEEDKRMKSIKSKASIYDEPMEDEEDQVLEKEMQEKGTIKAATYYLYLKAGGGICSMLALGFLFIICQVVANAGEYYVTYWVNLEQDFSEKQRMNLTAPNETINRDLIMWSYTALIVGNIIISVVKAVYFMIFFVIASKNLHKYIFDKLIKATMRFYNTNPSGRILNRFSKDLGTVDEYLPSVIIDVIEIALLLLGAITLSAIVEPLLTVPAVVLMIIFYLLKIVYSETSRSVKRVEAITKSPMLSHLTASVNGLSTVRAFHAEKMLTEEFDNYQDSHSAAWFLYLASSKCFGLWLDIICIVFIAVAVFSLLLFRDTIHGGDLGLVITQYLGLMGSLQWGMRQWTELENNMTSVERILEYTRLETEPERKEPKNIPQPWPEKGLVEFRDVSLRYSPQDPPVLKGLNFTVQPKEKIGIVGRTGAGKSSTITALFQLYPLEGTVVVDGVDTTQIPLDLVRTNISIIPQEPVLFSGKMRENLDPFENYSDDVLWNALDQVELKDVISELPAGLNTEVTEGGNNFSVGQRQLVCLARALIRNNKILVMDEATANVDPHTDSLIQKTIRDKFADCTVLTIAHRLHTVMDSDKILVMNSGRVEEFNHPYLLLQNVHGVLHNLVDATGPSTA

SEQ ID NO: 105 - protein, 1284 aa, Diabrotica virgifera virgifera
MDSTKETYNPNPRDSSNIFSILFFGFTYPIFKKGMKKDFDVEDLYNPLKNDRSTLLGDKLERNWDKQKLKPKGKPSLLRAVAITYWYEYLRLGFLTLIGDVFIRVSQPYVLGLLLTYYNPHSKTTKEQALGYAGMIVTFNTLTSFIKNQYMMNSMHAGMRVRTSVCALIYRKAIKLSTTALGKSSVGKIVNLLSNDVSRFDSASMLLHQMWVGPVSAIIIMYIIFQDIGWSGATGVVTIVTIMPMQAYIGKLSAKYRRIIAGKTDERIRLMNEVIGGIQVIKMYAWEIPFTKLISLARKAEINVIRRSAYIRGVFMAFNLFNNRFALFATLATMVFTNKAITAARVYVFMSYYQILANTLAGVFVNGLTQIAELLVSINRIEEFLENEEHKELPALKRSVISNVNEEMVACKNMVASWNENSLDPVLKNLNFKLGKNTLLGVIGPVGSGKSSLLQSILGELDIVDGSLAVHGTLSYASQEPWIFSGSIRQNILFGSDFDKARYDEVLKVCELRKDFDQFPDRDFTLIGEKGANLSGGQKARINLARAIYKDADIYLLDDPLSAVDSIVSKVLYEDCINGFLAKKARILVTHQVYYLKTADHILVLNNGGIEIEGTYSELLKSDNPLTVHLTEEIEEILKRQKSQDSAIEEQEAKTMSTMDLSKMNGKMKAIVKEMQEETSKGKVKGSLFLEFFKSGMSICEIIFLVTLLTIAQASATVIDWFISFWTNIEEYQMTLNSTAANVLNSTVVDALNSTAVDAINSTAVDVLNSTTVNALNSTVVDESVPFYMNWSSQTCLIIYGAILVFCLVTTLSRSLSFYRFILNCSENLHGMLFTGVTNTYMRFFDKNPSGRILNRFSKDIGSVDEILPRMLFEASRVTLKMLGHLVLVLYVNPASVIVVIILGILFSFIRIVYLRSSNNIKRLEGRMKSPVFSHLTATLEGLTTIRAFKAQNILRAEFDKHQDSHTSAWFMFISTSSAFGFSLDVICLMFIGSLTFSLIGLGEYFNLTGGDVGLAINQASSLTQNIQFLVRFSADISNQLMSVERILEYKELIPEQQPEKLLLPPKSWPDKGIVNIEHLNMKYIDDGPTILKDVSVKINPKEKIGIVGRTGAGKSSLISAIFRLTPLEGKIYIDDINTKDITLKQLRSKVSIIPQDPILFSGTLRYNLDPFDEYSDETLYRALNEVELKDPSNIINRLENRVMDRGSNYSVGQRQLICLARAIIRNNKILVLDEATANVDPQTDALIQRTIREKFADCTVLTVAHRLNTIIDNDRILVLEAGE

SEQ ID NO: 106 - protein, 968 aa, Diabrotica virgifera virgifera
MSNKIVTLAFRTEAKKFLTVLHKPLAYNRNKNWFSRTSKVPLPLGKESRNVPGSVPFKNRRTNLLRLPQSVAVSVGRSQHYCCSEWLSSISYSKRRLSVQKTSKNMPEGKPFERLPQNVKPKNYRLSLVPDLTALTFQGNVSIEVEVVSNTDTVVLNSLDLKLNEVTLKGDKSLKPGQVELCAEEEIATLKFPSLVTPGSYILDIAFTGEINDKMKGLYRSKYVNQKGEETYAAVTQFESTDARRCFPCWDEPAHKATFEISLTVPKNLVALSNMPVKNSQPEGDLIKYDFEKTPIMSTYLVAAVIGEYDYVEDKSSDGVLVRVYTPKGKKEQGLFALEVATKVLPYYKEYFNIAYPLPKIDLIAIADFCAGAMENWGLVTYRETCLLVDPKNTSAVSKQWIALVVGHELAHQWFGNLVTMEWWTHLWLNEGYASFVEFLCVNYLFPEYDIWTQFVNDSYIKALELDSLKNSHPIEVPVGNPSEIDEIFDDISYNKGASVIRMLHHYIGDEDFRKGMHLYLTRHQYKNTFTENLWAALEEASQKPVGDVMSFWTKQKGFPVVKVTQQPAGDGGGVKLTLSQSKFTADGSSPADEDYLWMIPISISTSKHPSKEVVCIVLTTRTAEIVVPEVGKSDWIKVNPGAIGFYRTQYTPEMLEKFIPAIRDRSLPPLDRLGLLDDLFAMVKAGHTSTVEVLKLLNAYEDEPDYNVWCSIVNVLGRLGQLLGHTEYEADYNKFQKRLLSKVYSRLGWTQKSGETHLDTLLRGLVLGRLAWLDHEHTISEARNIFDTHVKSEQVLPADLRSACYKTILRAGGEAEYDTLLQLYRSSDLHEEKDRISRAFGATKDPKLLKKVLEFAMSDEVRSQDTVFVIASVGLNSTGRDIAWQFFKDNWPQIRERFYGSLLTRLVKYLTENFASDERAKEVEAFFAEHKPPGTERTVQQSIETINLNTTWLNRDSAAIKEYLRTI

SEQ ID NO: 107 - protein, 766 aa, Diabrotica virgifera virgifera
MSKDSRYTPVNTNPDKNPTWWKRRTSMERCLTLSTGIALLIGISLLIALATVLYSRDQHVSNKPYTAQPLQGKIVTITSQDHEDEKVCLSPGCIHTASRVLEYMDESVDPCDDFYQFTCGNFIKKTNIPDDKSSVTSFTLIGDELQEQLRTMIEEPIQEDEPKPFKLTKKLYKACMNKTLIEEDGMTTITEVLKELGGWPVLEGDSWNEDDFDWKNSVYKFRKVGYGVDYFIDFSVVGDVKNSTKRVIDLDQASLGLRREFLIKGLDEKIVKAYYDYMVDLAVLFGAERERAAKELRASLEFEIQLAKISLPSEKRRNMTALYNPMTIEQLQEKFRSIPWVEYINNLLAPDTTVESGEIVVVNVPSYLKAFETLVSKTPKRVQANYVMWRAASNSVSYLTERLRKRQLDYTAVITGKTEREPRWKECIDITSVSLSIASGALYVRKYFNEQARQNAIDMVKDIRAEFQDILKVVDWMDEETRENALEKAKSMTSHIAYPDELLDDEKLKEFYDGLEMDRNQYFKSILNLTLFGTRFSFKRLRQPVNKTDWITHGRPAIVNAFYSSIENSIQFPAGILQGVFFNADRPRYMNYGAIGFVIGHEITHGFDDQGRQFDKVGNLVDWWQETTKKRFVEKAQCIIDQYANYTVPELNLNLNGINTQGENIADNGGIKEAYLAYDRWVKRNGEEYFLPGLNYTGRQMFWMSAASIWCSVTRKEELQQMIITDEHVPDKFRVNGPLANMKYFADDFNCRKGAPMNPEHKCQVW

SEQ ID NO: 108 - protein, 929 aa, Diabrotica virgifera virgifera
MTPLSFLSVLLVFLPFVYLQEYRLPKTVVPSHYALSFTFNRQVFAGTIFEFSGSTVITIKTSESVANIQLHADPSFLRIGAISLDQGGEIDSYNVDAVTQILTITTKAALNPEIEYKLTITYRADISTKEMIGLYQSTYQDANQATNYLVATQLEPTYARRVFPCFDEPSFKATFQVSFTLGPNITPRTNTKLESSNQMTPSILQYTFVTTPVMSTYLLSFVISNLDCTDAATINGVQNSVCSRPGTENLRDWAVNIAPKILASLGEYTKLDYNLAMNKMDYVAIPDFSVEAMENWGLSTYREQSLLYDPEHSTNIDKQNVATLLAHEIAHQWFGNLVTCNWWSETFLNEAFGDYFEYFAAHMILPAWQLDKQHVVNNVQKALRADEGNLPALQSTVSSPVEILGRFNVVSYTKGSSILRMVEHILGSENFKDGIYHYLNSHKFKSTTSSDLWRGFQAYLDNSYSILPNYLNLGAVMNNWVVQSGFPLVTVTVSEGNVQIEQRRFGDNGTDDNSKWYVPITFITSGSSGVPSTRPSYWLTPENNVAFQLPQGAEWIIVNNLQTGYYRVNYDTATWNKIEEVFKSNNFGSINEITRAQIVDDLFSLANIGEISYSRVLKFLEFLSEETSYFTWTSAFNGFQFLFNRLQNQSNLTETVTSNVLSLMDKLYKSTPFDVIDDDNQVFTLKKMLTLSWACQLGHPECLVMSRASFLSYKLSGVKPQKNLRSTIYCTALQTSSERENWDFLLKVHNEADLDSERPLLLKSLACTQNKELLQELLLLTIADDSPIAREDCITVLGSVAANSNGAEQAFDFVINNYDNITQRYQATNTIANILEIIGGAITTEEQVDKFRSFINGGQLPKDYVNDGERALEIAQKNLNWSEKHEKDLINHYYPESKEPDEPQPYTGEGVSIGSNGLIIGFIVSYLLL

SEQ ID NO: 109 - protein, 868 aa, Diabrotica virgifera virgifera
MEKNNCEKNCNRDQLAKYRLPDTVKPLLYDLYLYPDLKTGLFTGKVNISLEILKETESVSLHSKGLNIANVKVASQPGIFTIEKTYDLLNIKRQDNSKFIPGFDNVEIEFNGDMKNRIVGLYTSSYTTSSGEKRQIATSKFEPTFARQAYPCFDEPNLKAKYKVHLLKPKDSSYIALSNYPVENVTDYDNDHQLVTFDETVSMSTYLSCFIVSDFTHTETSFNNSGKIVPLKVFASPENLDKTRYAGEVGKKVIEYYVQYFQMPYPLPKLDLVAIPDFVSGAMEHWGLVTFRETALLYTNTTHSSLNKQRVATVVAHELAHSWFGNLVTMNWWNDLWLNEGFASYIEYKGVLAAEPTWGMLEQFIITDLHPVLSFDAKLSSHPIVKHVVTPDQITEIFDVISYNKGASILRMLEATVGDEVFQNGVKNYLNRYAFGNAVTKDLLSELQLLVGNKLDVTEMMDTFTLQMGYPILDVAISGDTYTLTQKRFLKDPNAVYNVNETKYKYRWSVPVTYVTNLGKSSEFILFKYSDNQVTIKKPAGATWLKFNTDQIGYYRVNYPLDEWQNIINNYKLFSTGDRTHLLEETFCIAEANQLNYTIPLELTKKLKDEIDFTPWSVATSNLKDILARLRGAKSDMISAYKEYITKIVSPAYNKFTWTEDASDKHLEKLARLRVLSLACSADHKEALEEARSKFNTWIETKQPISPNLRSLVYVYGIKNASESDWDNMLQVYMNETDASEKVKLMDGLSSVDNVNLLKKLLDLVKNESVVRSQDYLIVLGTISINPKGTDLVWDFVRSNWDYLVGRYTLNERNLGNLIPRITNNFYTPDRLQEIEDFFKKYPEAGAGAIKRKEALETVRNNILWVSN

SEQ ID NO: 110 - protein, 557 aa, Diabrotica virgifera virgifera
ATYMASLALEDLFPQWNSLEEEDADNILDVFSFDALRTSHPVSVPIGNPKEIDEIFDTISYKKGSSLIRMMTLFLGEEILRKGVSNYLKKHKYGNAEQDDLWEALTKEAHSQNVLPKNLTVKLIMDTWTVQTGYPVINVMRDYSKKSASISQHRHLRDIIYPKDASKPCWWVPLSYSTKSNPNFNSTTPKHWLSCPEHSQTIEDLGDENDWVIFNNKMAGIYKVNYDERNWNMITKFLQGPDFQTIPTLNRVQIISDAADLAYIGSLKYEIFFEMLKYLKKETEYMPWKAAIDKTDVITKHLKKSASYGKYKEYMRHLLTPIYEKFGGFEVTTDPEKLDYIKLQALIVSRSCAFEVANCVSQAKSLFNKLKEKQSDNVIPKDLRSAVYCTVLKHGGEAEWDFLWNKYQNSNVATEKSTILTNLGCTEEIWMLARYLDWSLNDTQIRRQDSSSVFASVSRNNVGYFIAKNYFYNNIDKVYKHLLTNKKTLSRYLSALSNQITDAKDEKEFERFIKGNKKTFAEVKKGVEQSLETVKINIQWQHTHAEEIADILNKYSK

SEQ ID NO: 111 - protein, 679 aa, Diabrotica virgifera virgifera
MWSSKISRTSFTTLDIYRRITRGVTNLAKSRQASTSDIHLFKVGEKYHGFEAKRIASIPELKTTALYLLHEKTKAQYLHLYRNDSNNVFSVNLRTTPMNSTGLPHILEHTVLCGSEIFPVRDPFFKMLNRSLATFMNAMTGPDYTMYPFSTLNYTDYLNLQKVYLDAVFRPQLKELDFMQEGWRLENVDPNDVNSDIIIKGIVYNEMKGVFASNDSILGQKLQNLILPSHTYGVISGGDPQEIPNLTWNDLKNFHKQHYHPSNSRLFSYGNFPLLPSLEYIDKEYLSKYAYSPPTHTVVPKEKRWEAAKREHIKCRYDVLGAPFEKQNTISISVLASDTTDAYQTLVVDFLTNLLIKGPNAPFYQSMIEPNISGGFTASTGFDNQPRDGMVTIGLQSVKKEDFDKVISIFEQTVDKVIEKGFEPHHIEMVLHSYELSLAHESSNYGLGLLFGISTAWNHTENIIEHLQSRKWIDRLKQDIKTNPNFLQDNVRKIFKDNQHKLILTMSADKDFEAELAKAENQLIKQKTKGLSSKDKKVIHEKALELQKQQMEPTRTELLPTLLIDDISSDVEKVDMEKVSLNNVPTQINKVNSNGIVYFKAMLNTNYLSPDQQMLLPLFCFTISKLGTDKLNYKEFDSLINRKTGGLTLNSHIGESLYSLHTYQPSLLLSSYALERNVE

SEQ ID NO: 112 - protein, 695 aa, Diabrotica virgifera virgifera
MFKYYFVVLCFSLYFAVGCFECLTYRLNPSEAVPITYEIVIKPDLDNDVFHGEVIIYVVTKISLNGITLHSDELNITDVYINQIKGCYVEETEERITVKYNNGPLQPGEHTLLFKYSGKIRPSHGLIKALYEYKDTKEYVYVTDLEPNKARRVFPCFDEPQFKAKYHIKLVSPNETYAAISNMPEITKFRTSYGIVHEFAASVPMSTYLVSFAFTNFPYYSENFEYQGRQIPIRIFTVNASKENNEFAMQCVKTALSFYSDYTDISYPLPKLDMIEYKREESAATENWGLITFRQGLLTTPLRIYSKFQIKLVAFHELSHFWFGNLVTNAWWNDIWLQEGFATYMSYKLSAQDNNNTQLDEMKSYNFNEFFETEIYEKSQPIVQYLPDPSKIADVFNGLVYEKASAILLMLEDEIGQEKFKEIIRTFLKKYAYHTATTNDFITVVEEVVSDIPLRTFLESYLYQNKFPVLNVDIVNNSTYVITQQICETVQQEPISATKWTIPISYQTDYSNDSKHVWFHREMEELRLEEADAKWIIFNPEGNQMYKAIWSTNIWNKIISNFDLMDYSTTDTVISDAYYSFRFNKIKCEIVIHLMEQLKPEHKRKWILFYAFYDHLKENLFCHKYTEEATLFWKFLKRRFSETNYPKTPKLRKPESCDNQYIIQNEDYRKNLDQCATWIRENLKEKDSNAIKTIL

SEQ ID NO: 113 - protein, 610 aa, Diabrotica virgifera virgifera
MVKAGLSPCDPSSFSRPDQVIVTELFLNLDVNFESKTLHGHAILSINKIDETATELVLDTFKLNITSIFDADKNCTEKLEYTLSDHLEDFGSKLTIQLPQKEVKKIHIEYETAPDASGLQWLQPQTTAGKIHPFLFSQFQPTHARSVIPCQDTPAVKHPYRATISAPKELEVLMSAINEGSKVIGDKKQYSFYQQIPVPSYLIALAVGALESRRLGPRSHVWAEKELIEESAYEFAETEHQLKTAEDICGPYVWGIYDLLVLPPSFPYGGMENPCLTFVTPTLLAGDRSLANVIAHEISHSWTGNLVTNKTFEHFWLNEGFTMLVERKIISRLVSPQMQDFDAYTGISDLKEAIEVLGADSPLTNLIVDLKGVHPDEAFSTVPYEKGQTFLRYLEKTVGGPDKFEPFLRSYFDTFKYKSIDTTDFKNFFENYFESEPEIKNIDWDKWLHTPGMPLTIPDYDTSLAEACDQLLEKFYNWTGEGSLPISAEDKQQLIPEQLIYFLQKLSEAESQPIPKLVALNELFGFDGVKNSEIKFRWLKTGIKAKWEVQIQNALDWVNVVGRMKFVKPLYRELFQWEVSRNRAIENFKSNRHNMMHVCATTLAKELKIE

SEQ ID NO: 114 - protein, 631 aa, Diabrotica virgifera virgifera
  misc_feature (281)..(281): Xaa can be any naturally occurring amino acid
ELKQEYYRLVTAQVKSSEQFEVAEKKKVVRAISLAESSTGSDHNIEATKEDNEDDFNENKDVSVFEILKMNAPEWPYILFAGLGSIVVGCGMPVFAVLFGSILGTLANGDPDFVRSETNKYCLYFVLGGLITMVSVFTQMYLLGIAGEKMTERVRSRLFKAMIYQEIGFFDKKTNGVGALCAKLSSDASNIQGATGIRVGTILQSIATFCLAIGLSMYYEWKLGLVTAAFTPVILIAMFFERRNTRGGNDSRDSALQKSTRTAVEAVGNIRTVASLGLEEXFQQLYESELMPHYKSSLKTVHWRAIVFGLSRSLLFFAYATAMYYGGFLIRDGLPYDRVFKVSQAQIMGTVSIANSLAFSPNFAKGVAAAKKVKSFLSRIPLIRDLPSSRQMVKASGNFSFSEIEFTYPTRPNVLILKGLNLDILNGKTVALVGESGCGKSTIIQLIERFYDPRSGEVKMDGVDLKDISLDSLRSHMGIVSQEPNLFNKSIAENIAYGDNSREVSMDEIIKAAKNANIHNFITGLPKGYETKLGEKAVQLSGGQKQRIAIARALVRNPKVLLLDEATSALDTESEKVVQEALNEAKKGRTCITIAHRLTTIQDADLICVVANGVIAESGSHQELLQKEGLY

SEQ ID NO: 115 - protein, 584 aa, Diabrotica virgifera virgifera
LFGMKSVGVGIGVILTTYISTVLFIYSASRQIFKIRKAFLEKTLNQDIAWFDQNRTGDFASTFTQNISKLEEGIGEKIGTFLFFESTFVAGCVLGLVKGWKLALVCMVSLPLSTTIMTIISWISTKFSAQEMESYGEAGTIAEEVFTAIKTVVAFDGQDKEIERYNKHLVDAKKNNLKRSFFTAVSNGCLWFFVYACYALSFWYGVTLILNDRHLPEHEQVYTPANMVSVFFSTLIATWNFGLGAPLLETFGTAKGAAQKIFFVLDSKPVIRKFANSGIVINDAALEVTFEDVHFSYPSRSDVKILRGINLTISKGETVALVGKSGCGKSTCIQLLQRFYDPDMGQIKINGIDIKQLNLDWLKQKISVVSQEPDLFSTTIAENIRYGKLNATQQEIENAAKKADIHTFIQTLPRGYQTVLGERGTQLSGGQKQKIAIARALVRTPEFLLLDEATSALDTTSEAEIQEALDSIRGTCTIIIVAHRLSTIRQASKIVVINEGKVLEMGTHTELMDMKGAYHNLVISQGLTETLEEKGNRRRSRKFSEANKSINEKEDEELEDTQINQPVAKNILWKVLKLNASEWF

SEQ ID NO: 116 - protein, 528 aa, Diabrotica virgifera virgifera
MVSTKNFVILIIATVVHQIRPVINIKEGQNFWKQRGYLELDEAINKKIIDGPANNVILFVADGMGMTTMTSSRIYGKGEQGSLAWEKFNNIGILKIYSANKLVPDSCSTATALFCGVKANHKTAGVDATVDVNDCDAAMKEESHLESIMTWAQAAEKSTGFVTTTRVTHATPSALYAHIPNRSWECESKIPQNSTKCKDIAKQLIQDMPGKKIQVIMGGGRQCLQSSVPDSPADPVDTWSCYSKDGRDLITDWKKDKEKNGYTYQVVNNNEELQNLDLQKEYTLGVFANGHLKYDYERDKGPKGMPSLANMTEKAIQLLQNNKNGYVLMVEGGMIDQAHHRGHARKALGETIGFSDAIERALELTDPSETLIIVTSDHSHSMILTGYPDRGRGVLSYTNSAMDNLPFTSLLYGTGGPNNYQFVLDNNTATRIDPSKNNTGDWEYSQQALVLTDEVTHSGADVLVFARGPMAHLFNSVHEQTYVAYVIAYATKIGPYSDSTNGSVGFSDFKYIHVITIFLIVASFVIGD

SEQ ID NO: 117 - protein, 315 aa, Diabrotica virgifera virgifera
KLPVSVVPTHYKIHLLPDLSDFTFKGEVSINIEVKTSTHEIKLHSLDLELNSITLKHEGEQYTPIDTKLHTEEEMAVFKFKSSLTPGNYTLDIAFSGKLEDNMKGFYRSKHVDEKGAEFYSAVSHFAPTDARRSFPCWDEPAIKATFDVSLTVPKHLLALSNMSILTSKNKGELIKYTFHTSPKMSTYLVAYAVGEFDFVEKISSDGVLIRVYTPLGKKEQGEFALDVATKVLPYYKQYFDIAYPLPKLDLIAVGSLGFSAMENWGLITYRENRVLIDPQNSSNSTKQGVALVVAHELAHQWFGNLVTMKWWTDL

SEQ ID NO: 118 - protein, 312 aa, Diabrotica virgifera virgifera
VNHAKTIANIINGLYSPLNIFIALVGVVIWTENDEINFSPNGDTTLTNFLHYRREKLIKSHPNDNAQLLTKFNFDHGVVGKALKGPICTYEFSGGVNTDHSPVVGLVATTVAHEMGHNFGMEHDTNECECPDDRCIMAPSSSTVAPKHWSSCSLNYLLQAFTHGMDYCLKNKPKALFDSPVCGNGFVEPGEQCDCGLEEHCDNYCCNATTCMLHSNASCATGECCDLTTCLPKGAGTLCRSADYECDLPEYCTGQSEYCPEDNYKLDTEVCDDGKAFCYHGFCSTRSDQCKLLWGETGKSSDDQCYMMNTKG

SEQ ID NO: 119 - protein, 283 aa, Diabrotica virgifera virgifera
AHEIGHNFGSPHDYPPECRPGGPNGNYIMFASATSGDRPNNSKFSSCSVGNISNVLDAIEEKKKRNCFTASAGAFCGNKIVEAGEECDCGYDDKECNDQCCYPRVISVRDKELNRSAVGCTRRAGTECSPSQGPCCSGECKFISSYRQEVCKMESDCSRSSKCNGSSAECPVPTPRADKTRCNNGTQLCIKGECSGSICLEWNLEACSLTTQDHPNIDKRKLCELACQNGTDICRSTSEFADRVGLPPGGISLRPGSPCDNFQGYCDVFLKCAPVQEPILRLT

SEQ ID NO: 120 - protein, 302 aa, Diabrotica virgifera virgifera
  misc_feature (20)..(20): Xaa can be any naturally occurring amino acid
PLDHLNLNQAGYYRVNYDDXLWTRIINTLHGQDKNKIPVLNRAQLIDDIFSLARAGKVDYKKAFELLDYLKYETEYYPWASALRTTSHILEHVNDKTKVLLKSKLLTLINAAFPSVTEIKSSKHVDILKEHLILHWKCFLDDNNCLNSAKVKFEEFKNSNSFQNNNERDIGLSFGVRTSNNVFYDFNFLMTHYEQLKSRVEQESILRSLGCFVDATILENYLKEIVSEKSPIVSYDALKVFESVLSHKQGVEAALKFLEVTKSIIINKYSKILSLTDFIILLENKITTQEQYEQLKNIVTNN

SEQ ID NO: 121 - protein, 260 aa, Diabrotica virgifera virgifera
MARVVALFLIFVHATNCYRLPKDVPENYKLEIISNLGAPKDSFNFDGKVWITVTCTHPTQNITLHSKHLDIKDDDVILKDITSNDSKTVKISNVEFKEEFEFLILNLEEDLNTDHKYEIYIGFSGKMDDGLAGFYRSSYYDKKDKEKKWLGVTQFEPISARMAFPCFDEPEMKATFDISIGRKEGYTVISNMPVLRTEPLKEKDGWFWDRFDTSVPMSTYLVAWVVSDFDYKSGKLVENNNVTFRIWARKDAINQVDFAT

SEQ ID NO: 122 - protein, 294 aa, Diabrotica virgifera virgifera
WGNTEPLDYERSHNHILSVIAYDCGMRQSFPALVTIKVNRVCRLGWRGLPERVDYAPMTGKQELFPSANLELCDVPCTIRELRTRVDLATRHIGKGCDRDTYSVQSQRKLCGASPSAIDLLPNPGVGAEWTKPLISDEGHESDQMFEFDGATTAVTIPTSVLEHQLPTTFTISTWMRHGQHPTQDKHLKEHIFCTADDHKMNRHHYALFVRNCRLILLLRRDFSEGDLNIFRPAEWRWKISQVCDDQWHHFAINVRFPDIQLYIDGQLFRAEKKNPEVIDDWPLHPTKGINTTL

SEQ ID NO: 123 - protein, 262 aa, Diabrotica virgifera virgifera
EELREIISNYEYSGLYDNFLLKLVTPMYNELGTDTRVFDTQNEKLLRLHIVISACKLRYGKCITWARNIFYQWMKEEDPDAENPIPVDYRFIAQCAAIKSGGPVEWDFLWNRTRYANIAPVDLQTAYQSLGCTYDPWLINRYLEYSLSGNVSLEYVPYVWQSINHPVGVRTGFQFLRLNWNLIYKTYEEVYLVFSTIFHDFLGQFSTEADLEDLTTFYKIHQTDLKTISTILQSTVDRIKVRINWKTKHLDSVVNWLKRNRY

SEQ ID NO: 124 - protein, 224 aa, Diabrotica virgifera virgifera
MFSDCVAVLLLLLVLPFIESAERLNEYIRHYETLAYDTEAVHRAHTRAKRSIASDNYVHVAFKAHGHDFRVRLKRDLHVFQDKLEVQGPTGEPLDVDTSHIYQGHILGEPDSVAFGSIIEGVFEGKLMLPSKGAFYVEKAHHYFPHTTHPNRTFHSVIYHEDHVEDPYAHKREGHSAGCGINDDVIEWMNKIQSSGEDLPITPSTVAFKKAVKHKKHLKTKKDK

SEQ ID NO: 125 - protein, 155 aa, Diabrotica virgifera virgifera
MEMTKEKYNPNPREKANILSTLFFGYTYDVFKKGLSKTLEVDDLYNPLKIDRSKILGDHLQSNWDKQLEKAKKTNSKPSLLKAILMTYWLEYLKLGIFDITTDLVLRLIQPLMLGKLLDHFKPEAQVSKNEALMYAGIIVAINVLNFLIGNQYMV

SEQ ID NO: 126 - protein, 217 aa, Diabrotica virgifera virgifera
  misc_feature (103)..(103): Xaa can be any naturally occurring amino acid
MRTKLVIFLCLVLFVTSVYNEDIPVNSLLDELHPAAEFSRHTLVKPKLYHGREKRQISSTKEKSGKHTDHLQITMEVDGEDMILDLTINKDLIPEGFFHKHQXNGDYKIHQPTFQEANICEYNGKVRGKPNSWVALSTCDGLSGVVFDGEEMHYVEKGNSIGDVEADHFLYKYSDLLEHNKTCGYAGDAVDPEKAVHAHNNNRILRYKRDTDEQLVR

SEQ ID NO: 127 - protein, 188 aa, Diabrotica virgifera virgifera
RLNVSIIPQEPVLFSESVRYNLDPFEKYSDEILWKAIESVELKHAITDLNQTVSEGGSNFSAGQRQLLCLARAIVRNNKVLVMDEATANVDPGTDALIQKTIRERFRDCTVLTIAHRLNTVMDSDRVLVMDAGEAVEFDHPFKLLQNPDGYFSRMLRETGPAMEEMLKAVAEEDYNKKYGGIKGKKGE

SEQ ID NO: 128 - protein, 109 aa, Diabrotica virgifera virgifera
CMSVSSLKKQGPHCPDDCNGNGWCNNKGHCHCKDGFAPPTCDYPGPGGSLDSGPAADPNGQYLEKKICEITNKAAEKYLRSGINIKCLIPFCCPPKHPIRNLILKDLGD

SEQ ID NO: 129 - protein, 164 aa, Diabrotica virgifera virgifera
  misc_feature (14)..(14): Xaa can be any naturally occurring amino acid
HSDEILWKALENVXVELKGVVTDLNQPVSEGGSNFSAGQRQLICLARAIVRNNKILVMDEATANVDPQTDALIQKTIRERFRDCTVLTVAHRLNTIMDSDRVLVMDAGQAVEFDHAYRLLQNSDGYFAKFLKDAGPPMANKLRDIAKEDYYKKHTSPEVIVDDD

SEQ ID NO: 130 - protein, 179 aa, Diabrotica virgifera virgifera
DENKNTCSLYIQTDPLIWRHIREGFPEHLDPKKQQEVNEKTREEILSIIAHHVTAVNYIYRDTKFDGKSEHRNIKFEVQRIKIDDDSSCRCYHRGCGEMNQFCLENIDVSNFLNIHSLGNHEDFCLAYVFTYRDFTGGTLGLAWVASASGASGGICEKYKTYTETIGGMYQSTKRSLNT

SEQ ID NO: 131 - protein, 177 aa, Diabrotica virgifera virgifera
LVAFTISDMKSISANITAGPPVKIWAPETDLSQAQYALDVIMELLPFMEDYFDMKFPLPKLDLLAIPNFGKTAMENWGIISFRKSSVLFDPNSTSIKTRSYILAKIAHELVHQWFGNLVTMQWWSDLWLNEGLATFISEIAITTLRPKWHAYSSIKVRDTYNTLNDDSLKSARSMQR

SEQ ID NO: 132 - protein, 163 aa, Diabrotica virgifera virgifera
MGRGGYHSNRAEFLSDEAILKYSRNGGCFVTTKKAIGFVVFALISLLIVVLLMYYYGPTKTSEKIIKESNDIEKLINDTINEEATKEALRLPKSLYPLHYRLWVHPILDEHSENNFTFTGRVIIEVKCIEDTNKIILHADDLNISESDFKVYTTRQVEITTEL

SEQ ID NO: 133 - protein, 149 aa, Diabrotica virgifera virgifera
  misc_feature (31)..(31): Xaa can be any naturally occurring amino acid
DHLNFGKENSWGLLLEREENLLDEGSKTSVXEKQRIIQTLTGEIAHQWFGNYITPERWSDVWLNEGFTTFLKYHLPDLTLQELETTNQFSIEILQDALYQDSIQGEEELSTIENTAMNPKTQERMNKFKAIKGASIIRMMQSTLGRKNI

SEQ ID NO: 134 - protein, 155 aa, Diabrotica virgifera virgifera
  misc_feature (22)..(22): Xaa can be any naturally occurring amino acid
  misc_feature (38)..(38): Xaa can be any naturally occurring amino acid
WTEHPSRKKLEKPEVLSCLHQXKESLQVPSMELLQPGXMELLTNSDLTEVTVEGDNRTNLETLVRKIGYANTREFPTPGRRNLRLTTTVTCDNGKQVKVPDAQTYVMVLRPQTPSIMLNGTGNMARKYEDFRMGVRVLADIHITGEQKLDKCQLT

SEQ ID NO: 135 - protein, 145 aa, Diabrotica virgifera virgifera
DHSANYISIGSALERKFYLNGERHIFLPGEYTVAGTQALYGRDNHLEKIRIPGPIMEPIVIYIYYRGNTFNPGVEYKYSIWKQVKPIEVKYSWILGEWSQCSVTCGGGTQQREPLCQELVLERMSSEIERPNMVTNITNHKISPI

SEQ ID NO: 136 - protein, 119 aa, Diabrotica virgifera virgifera
  misc_feature (18)..(18): Xaa can be any naturally occurring amino acid
MYSTRISLFVSILAYVLXDMTSPPKKVFVITSFYSVLRQSLTVFFPQGIAQVAEVRISIQRLNKFMQFEEIDMVREKFGRCSMSSSKSLDLSKSGNGVEKSERKGELGVFLNNATAKWS

SEQ ID NO: 137 - protein, 85 aa, Diabrotica virgifera virgifera
  misc_feature (27)..(27): Xaa can be any naturally occurring amino acid
MTEEKKHSIKDKEKIGIDAQFVNSEEXKGKIKNVSFPQMFRYASTYDKFLMVVGLISATGTGVLQPLNTILFGSLTGDIIAYATS

SEQ ID NO: 138 - protein, 1474 aa, Diabrotica virgifera virgifera
MGRLHCLFCIFLCFTVINTQTTNIHGFSENSVDTFLSPHGKSAKFVHQNHKPKIENCQNYKPSVKEEQPGGTYVTTVTAIDDDPREGGGTISYKLIHREGEHVLFDIDNVTGVLTTIQPFDRDEPVRQKELYVTVQASDNGRPPLADVCTFTVTITDINDNAPQLDKLKYDAQVSEDLKVGSEVMRVFAYDIDDGENSRLSYNFSNENAQFTQYFRIDRDTGVVYLKEALTDKKNTRFNSAVYVADNGVNDQEGQKDSTAKISITVVGSDKQPPRFTQKMPDGILEIPEDFKDFSKHIVTVEATSNIADPQLAFELVKGKTYQTNKDQTFLLEAEGNKAHIKLVRPLDYETVTEYTLTIRVKNKDLMDSSINIPIKVLDVNDEIPNFLEFLKGSVVENDKPGAQAIQVRAIDKDGTAANNIVSYELVDNTDLFAINRSTGVITSRVEFDRETVPLYHVNVKAYDNSPSALYNTTLPNIVIQTFQISIEDQNDNKPVFTHPIYQFSNITELADKSSIVGEVKALDNDTASVISYSITNGNIDDAFMIENSTGRIRVNGKLDYEKIEQYNLTVRAFDGAFEDFAIVLISILNENDEPPVFDDYIREIQIKEEEPMISGCVVRVTAHDPDIKDRHADQHIVYEVAKEQKDFLTVSADGCVQVTKPLDRDPPFGSPTRQVFIYARDNDGGTNSLLATAEIEIILIDINDNAPFLNVTEIVYYENQDPGFIGNLSADDYDGPDNGPPFAFRLSDTASDSIRSKFSIIGNQLFALEMFDREEQKYYDIAIDITDSGVPPLTGTSILRVIIGDVNDNPATDGNSTIFVYKYVNGPENFMEIGRVYVTDLDDWDLNDKVFVQEDNFDEFVLNQHNNGMILMKPTTAEGTYEVHYRVTETHEPTIHEHTVNAIVTITVKVLPEEAVVKSGSIRLRGTTKEEFIENSLNGKSKRDILHQELSKILNTSLANVDVFTVLNSPHQNSSFVDVRFSAHGSPYYAPEKLENKVTDHQMELEQKLDVEFYMINVNECLNETTCGAENSCTNKLNITREPAVVFTNRTSFVGVNAFIDPVCAALPRDVMECFNGGVLIENTACNCPAGFEGPHCEILAIGFTGTGWAMYPSFDATNRTEIILHILSQTDNGLIFYNGPLNIRQTSLSKDYISLELKDGYPLLQICTGSSTQEIYLKERIHKLSDGSLHKIKIGSGFDDISLEVDDCGTTCSIWTNKLHKGVIRANGPLQLGGMKNRFTDQEFKRIWDHLPPTATRFSGCIRNLTYNEFYYNLGAPSDAFQAYPDCNYAVMQAVTFGIDSNFLVAILVCVAILIILLLAVVVHRRKHDNFNEKEIDDTRENIINYEDEGGGECDTNYDLSVFHQNNIVDEKPLMRDNPDVPADISGFLDNKKDNCDKDPDNLPYDDVRHYAYEGDGNSTGSLSSLASCTDEGDLKFNYLSSFGPRFRKLADMYGEDPSDEDSHDGNEESWC

SEQ ID NO: 139 - DNA, 663 bp, Trichoplusia ni
cggccagtattcgagcgtgagatctacaccgccggcatctacgagacggatacatccaacagggaactactcactgttcatgcgacacataccgaaggcctagacataacgtacacgatggacctggacacgatggtggtggacccctcgctggagggcgtgcgtgagtccgccttcacgctgcacccgagcagcggcgtcctgtccctcaacttcaacccgagcgccactatggtcggcatgttcgagttcgatgtcgtggctacagacacccgtggtgcagaagcccgtactgacgtgaagatctatctgatcactcatctcaacagagtctacttcttgttcaacaacacgctggatgtcgttgactccaaccgtgctttcatcgcggacacgttctcgtcggtgttcagcctgacgtgcaacatcgacgcggtgctgcgcgcgccggacagcagcggcgccgcgcgcgacgaccgcaccgaggtgcgcgcgcacttcatacggaaccacgtgcccgccaccaccgacgagatcgagcagctccgtagtaacacaatactgctgcgtgcgattcaggaaaccctgttaactcgcgagctgcatctggaggactttgtgggtggctccagcccagagctgggcgtggacaacagcctcaca

SEQ ID NO: 140 - DNA, 327 bp, Trichoplusia ni
cggccagtattcgagcgtgagatctacaccgccggcatctacgagacggatacatccaacagggaactactcactgttcatgcgacacataccgaaggcctagacataacgtacacgatggacctggacacgatggtggtggacccctcgctggagggcgtgcgtgagtccgccttcacgctgcacccgagcagcggcgtcctgtccctcaacttcaacccgagcgccactatggtcggcatgttcgagttcgatgtcgtggctacagacacccgtggtgcagaagcccgtactgacgtgaagatctatctgatcactcatctcaac

SEQ ID NO: 141 - DNA, 402 bp, Diabrotica virgifera virgifera
aaagaactaccagtaaaatcaggaaagctagaaatagatgggaaagtgtcttatgcttcccaggagccatggctttttgctgcgagcgtacgtcaaaacatcttgttcggtgaagaatatgatgaagaaagatacaaactggttgtagaagtatgtgccttaaaatcagattttgccttattcccccacggagataaaactttggtcggagagaaaggaaaagccctaagtggagggcaaaaagctagagtgaatttggctagatgcgtgtacaaaaaagccgacatatatcttctagacgatcctctatcggctgttgatgctaacgtaggaaaacatctctacgatagatgcatcaaacagttcttgtcaaacaaaatatgtgttctggttacacatcag

SEQ ID NO: 142 - DNA, 1535 bp, Diabrotica virgifera virgifera
aatccagatctggcttcttcagatacagatccagatctatttcccgtacaaagagcgactgaagaagcagaaatctccagtaacaagtacttgttatcatcaccagttattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttatacac

SEQ ID NO: 143 - protein, 221 aa, Trichoplusia ni
RPVFEREIYTAGIYETDTSNRELLTVHATHTEGLDITYTMDLDTMVVDPSLEGVRESAFTLHPSSGVLSLNMNPLDTMVGMFEFDVVATDTRGAEARTDVKIYLITHLNRVYFLFNNTLDVVDSNRAFIADTFSSVFSLTCNIDAVLRAPDSSGAARDDRTEVRAHFIRNHVPATTDEIEQLRSNTILLRAIQETLLTRELHLEDFVGGSSPELGVDNSLT

SEQ ID NO: 144 - protein, 109 aa, Trichoplusia ni
RPVFEREIYTAGIYETDTSNRELLTVHATHTEGLDITYTMDLDTMVVDPSLEGVRESAFTLHPSSGVLSLNFNPSATMVGMFEFDVVATDTRGAEARTDVKIYLITHLN

SEQ ID NO: 145 - protein, 134 aa, Diabrotica virgifera virgifera
KELPVKSGKLEIDGKVSYASQEPWLFAASVRQNILFGEEYDEERYKLVVEVCALKSDFALFPHGDKTLVGEKGKALSGGQKARVNLARCVYKKADIYLLDDPLSAVDANVGKHLYDRCIKQFLSNKICVLVTHQ

SEQ ID NO: 146 - protein, 512 aa, Diabrotica virgifera virgifera
NPDLASSDTDPDLFPVQRATEEAEISSNKYLLSSPVIPTHYDVGLTVPLEALSGGSTNYDGTVDITLSVINATNVVQLHSLVNIVSITFTDSSIVIHNYTLNPNLETISIFLNSTLNANAIYKLNIKFNASLEKVNMRGFYRSDYIINGTKEYLATTQFQATSARRAFPCFDEPGLKATFQLTLTHPSEFNAKSNTPSQSQAVVQATNTTTTVFEKTPVMSIYLIAIVISKFNCTSSTNLGTNFGVCSRTDLSNDRNEALKYGMKILEAFDTYTASPYNLTNLKKLDQFAIPDFSAGAMENWGIVTYREYSLIWNNEQTSRALRQSLLSIVAHEFAHNWFGNLVTTKWWDTTFLNEGFARYFQYFILTKITDLSDFQMDKQFIVEQQQTAFIEDASPLSRSLTSEAWTPAEISNKFNTISYNKGACVFRMIENLIGSVAFQTALQKYLNATAYGSGTTEKLWANFPNSIALPPNVNFTDFVDNWTNKPGFPVVNAVFNGKNVTFSQKRFLYT

SEQ ID NO: 147 - DNA, 335 bp, Diabrotica virgifera virgifera
aatcatggcggcgtaataccaactccactttttactattacaggggtggacaacactgattgtcctaacttgaatgttgaatttactcaaggcatgaagtttaagttttcgattaatgaaagttgtatattctatgctgaacagacatttgactacgaatcgaatgaaagatcatacaatttcagaatttcaaagtccgtaaatgacgagatagatattgcattcagtatcaaaaatatcgatgatgaacctccacaattaggaacgtttaaatgcaactttaatgaacaattagactatagtcttgatgacacaccatgcaatactacattgca

SEQ ID NO: 148 - DNA, 253 bp, Diabrotica virgifera virgifera
acctagtcaagtaaaagctactaaagttcttgataaggagtcgctacgaaatatagagatatctaatcctattccacagaaaaacattgaaatttctgtgtctacccttcctgtggatagcgcaacaacaaaaaacgttgtgatgagggcacagagtatgcgagctactaaacagactgacagacccaacatacaaacattcggatctatgagacagccaaatggctacaagagaccacttagcatcccttca

SEQ ID NO: 149 - DNA, 4002 bp, Diatraea saccharalis
atggcaaaacaagaagaaaatttctttcataaagataggaagaaaccgaacatactatctcggatattcttttgttggatttgcccagttttagtaaaaggaaaccgtagggatgtcgtcgaggatgatcttattgtgccaagcaaaatctataattcaaaacagcagggtgacaaattagaaaagtcttggtcggcagaagtgcaattagcccaaagagaaaaccgaaatccatcactgtgggctgcgttgcggagggcttattggcttgagtatatgactggtgcaatatacatcttgactataactgctgtcagaatcgtgcaaccaatgttatttgcgcagctcttgtcctactggacagtggactcggaaatgacgtccttcgatgcaggagtgtacgccttggcactgctcggcttaaacttcgtcaccatgatgtgccaacaccataacagccttttcgtcatgagcttcagtttaaagatcaaagttgcttgctctgctgtgctctacagaaagcttttacggctcaatcaagtgtccgtgggcgaagtagcgggaggcaagctagtgaatttgctttccaatgatgtggcgagattcgattttgcatttatgttcatgcactacctttggataattcctattcaagtagccatcgtactgtatttcttgtacggtgttggaggctacgctccattcgtagggctgttcggagtcatgatcttgatcttaccaattcaagctggcctcactaaattaacggcttcggtaagacgtaatgtggcgataaggaccgataaacgtattaagttaatgaatgaaataattaatggaatacaagtcattaaaatgtatgcctgggagaaaccctttcaattagttgtgaaggcagtgcgggcacatgaaatgagcgctttaaagaaggctatctttatacggagcgttttcctcggcttcatgttatttacggaaagatcgattatgttcttcacggtgttgatgctcgcgctatctgggaatatgatttctgcaactacggtgtacccaatccagcaattcttgagcaccattctcatcaatttgacgatgatattaccacttgctattgcgacattatccgagatgaaagtgtccttagaaagaattcaaggtttcctggagttagatgaaagagaagcgctttcacataagaatggtattagtaatggagctttaaacagaagccttttcagttctaaacaaggggccatagagtccgatatcactgcgaagaaatatgtttcgaccgatgttgtagagacactacaaagcgaaatcaacaagtctgctaagcctagtgagtttgctgtggatgtgtgcagtgtgactgcctcttggaaggatgtggcctccgaagaagccactcttaagaacattgcgatgcgtgtgcgccacggaaagttatgtgccattattggacctgtaggctccggaaagacatcattgttgcaattattgctaaaagagttactgcctcacgccgggtcgctggccatcaatggaaaggtatccttctcctgtcaggaatcatggttgttcccgggaacggtacgggagaacatcctattcggatcaacttttgattcacaaaagtacaaagaggttacccgcgtatgttgccttgtgcccgactttaatcagtttccttatggcgatcaatccttggtgggcgaaagaggagtcactctatccggaggacagcgggcgcgtatcaacctggccagagctgtctacagagatgctgatatttatttgctggacgatcctctatctgctgtcgacgccaacgtaggtcgactactgttcgaaggctgcatccgaggctaccttcggaagaagacatgcctattggtcacacatcaaattcattatctcaatgattctgactggattgtaatattgaaagatggcactatagagaatatgggaacctacgatgatttagtaaaatctggaaaagatttctcactactactaaaagaactgcaagatagtgatgacaccggtaaagaagaaaatttagaaaagcggccgtcaatgcaacgtggtatgtctgtcaaaagtgaagagaatcctgaagatcaaaaggaacaggtactagaagctgaagaaagagcaaaagggaaccttaagtggacagtagtggcgcagtatctgaagttagttaaatcgtatcctttactgttcctggcagtacttacactactaataacacaagcagcggccaccttcgtcgactactggctcagtgctttgactaacgctgtagacgcttatgttcaaacggtgcctgaagatcaaactcctgatccaagtcttggtaccagtttgggctcactaacaacagggcaatatttatggatccatggtggcgtgatcctgggcatcatcgtattttcacagctgcgaattcttacttttgttattacaacaatgcgtgcttcgcaaaatatccatgataaaatatttaacaacctcattcaagctgtcaaaagattctttgatacgagtccttcaggtcgcgctttgaataggttttcaaaagatctcggtgcagttgatgaacttcttccaaggagtttgctggagactttacaaatgtatcttgctatgaccagcgtattggtgctaaacgccatagctctaccctggactctaataccgacgactttcctggttgttttatttgttttcctactcagatggtatctacaagctgcacaggcagtcaaacgtttggagggcaccactaaaagtcctgtgttcggtatgatcaactcaacaatatcaggattatcaacaataagaagttcgaattcggagtatagattgcaaaatcaattcgacaaagcccagaatcttcattcgagcgcattctatacatttctcggtggatcttcagcattcggcttatatttagatgtgctttgtctggtgtatctcggtttagttatggctacgttcatattatttgattttggtggcacgatcgcagtgggcagcgcagggttggcggtcagtcagtcgatggtgcttacaatgttactgcagatggcagcacgattcacagccgattttctcgctcaaatgacgtctgttgagaggacactcgaatatgccaagctgcccaaggaacaatacatagacgaagggcctactaagccaccgcccatttggcctgccactggacatatcacttttgaaaatgtatatatgaagtatggaccagaagatccttatgtattaaagaatttaaatatcgaaatacgcagtggatggaaggtcggtgttgtaggaaggactggcgctggaaaatcgtcattgatatctgctctatttagattaacgaatattgagggcgctatcaaaatagacggaatcgatacgtacggcattgctaaatcggtgttgcggtccaagatatctattataccgcaggagcctgttttgttctcgtcgactgttcgatacaatttggatcctttcaataaatacagtgacgacgacttgtggcgggcactagaacaggttgaacttaaggaggcaattccagcattagactataaggttacggaaggaggaagcaacttctctatggggcagagacaactattatgtctggccagggctgtgctgcggtctaataaaattttaatcatggacgaagccactgctaacgtcgaccctcaaaccgatgcccttatacaaaagaccatccgtcgagagtttgctgcatgtacggtaatcactattgctcaccgtcttatcaccatcatggactctgatcgtgtgctggtgatgaataagggagaggccgttgaattcgattggccttacgtagtgctttccaaacccgacagccacttcaattttctagtcaaagaaaccaatgatagtatgagcaaagttcttcatgatattgcaaagactaagtattttcaagaaaatccacagtaa

SEQ ID NO: 150 - DNA, 4104 bp, Diatraea saccharalis
atgaacagcaagaaacaagcgcatggccaaaagccaacacaagagaagaacaagagtaaagattcgcctctacaaaaggatgttcctggtattttatcaagattcttcttttgctggatgatgcctttatattacaacggcattaaaagggacttagaagaatttgacctagtgcctgcgaagcatcaatatgattctaaagttgtaggggatttattagaaaggaaatggctggaagaggaggtaaaagcaaaagcggaaggtcgcaccccgtctctcaggaacgtgttgatcaaaacatactgggtgagcttcattcccggcggcattatgcagttcctatatgtatcgatcaggactgtgacaccactcctgttcgcgcaattgctgcagtattggtcggtgaattcaacaatgtcccgtgagacagctgtggtgtatgccgtgagcatgattgccgccaactgggtggctgccttctttaatcaccacggcaacctgtattgccagcagtttggaatgatgttacgcgttgctaccagctcgcttatgtacagaaagttgatgcgtatgaataacgcttccttaggtgacacggctgttggcaaagtagtgaatattctctctaacgatatgcagaggttcgatatggctatgctgttcctccactatgtatggatcataccaattcagatggctgctgtgtgttatttgggttacttgcaggcgggccccgcggctcttgtaggcctagctgctttaatcgttatcgctttgcctattcaaggttatcttggtcagctaattggaaaactgagactacgaattgcggaaaagactgacgagagaattaaagtgatgactgaagttattagtggtatacaggttattaaaatgtacgcttgggagctgccattccaaaatgtggtgagcgagaagcgtggtgccgagatgaaacaagtcaggatcgcgctgctgtatcgtaccgtattcctgggcttcatgatgttcacggaacgagcggctctcttcatcacagttctagtcttcatccttttcggaaacacaatgactgcaaatattatctatcctctgcagcaatttatgaacgcggcgcacatcaacataactttagtgttaccccttgtgctggcttttaccgctgaactcctcgtctccattaaaagaattcaagatttcctgattttggaggatcgtcctgacttggttaagagttcacatacatcttcaccagggaagttattccaaaagtcatcttctgttttcgaaaagattgaagggcccatcagacctctctcttttcaaacacattcagaattcagtgataatgttggtaaacagcaaatgccaccggtaaatcgtatgatgcttcgatcgttgtcgcagcctggaggggataccgctgtggaactacgtaacgtcaccgctagatggaccagcgatcctaacctttgtgccctcaagaatatttcagtaaggataaggagaggcaaacttttcgccattataggtgccgtgggctcaggaaagtcttcaattctacaactattgctgaaagaactacctgctgccaatggaacagtatcaatctacgggaacctttcatatgccagccaagaaccatggctgttccctagtacagtcagagaaaacatacttttcggattgccttacgacgctgaaaagtataagagggtttgtagaacttgctgtctcgagaaagatttcaagcaattcccctacggcgatcagacgttggtgggtgagagaggggtgtccctatcgggaggtcagagggcccgaatcaatttggctcgctcagtatatagagaggctgacatttatctcttagatgacccattatcagctgtggatgcgaatgttggtcgtctattgttcgaaggctgtatcaacggctacctgcggggtagcacgcgaatccttgtcactcatcaaatacacttcctcaaagcggctgactatattattgtgatgaatgaggggcaaatagaaaacatgggtacgtttgaagaactgacacaattgggcaaagagttctcaactatgttggcgtccttgcaagaaggcaaggataaggatggtgatagcattggttctggaggaagtatggagagtaaagaaaagaaacgacctgcaaggactatctcagtcaataatgaggtagaagagtttgaagagtttgaggctcagaaaatgcaagcggaggagcgggcctcgggcaacttgcgctgggatgtcgttgtggcctattttcgttcgggcggtagcatctgtttcatcttgtttactctcttcatgatattactagcctctgctgcatcggctgctacagattactgggtcagttattggtcgaacagcatggcagcatacgaggaatccctcgagggtgctactccggaacctggattagatgtgcaagtaggaatgttcacgaccggccagtacttgattatacacgggtctttagtgttggcgtgtatccttattaccaacctccgtgtgttcccatttgttggactttgcatcggtgcctctaagaaacttcacaactttatgttttctacaatgttaaagggaataatgcgtttcttcgatacgagctcctcaggacgtatcctaaacagatttacaaaagacatgggtgcgctagatgaaattttacctcgaacactgcttgacgtactccagattaacggcgtgttactcggcattttgatactaaatgcaattgctttatactggacattaattccctctgctgtgatgcttttgcttttcttcttcatggttaggatttacttaaagatggcgcaaagtgttaaaagactggaagggacaactaaaagtcctgtgtttggtatagtgacatcatctctaaacggaattgcgactatcagatcagctggagctgagcaaaggctgattaatgattttgacaatcatcaggatttgcacactgctgcgtggaatggttatctctgcggaggtggatcttttggattatatttggacaccatgtgtttggtttacctcacaactgtgatatttgttttcctatatcttgatttcggtgatataatagctgtgggtagcgtcggtctggccgttacccagagcaacatgttgactgccatgcttcagcacggagcgcgtatgctggtagagtttatagctcagctgaccagcgttgaaagaatacttgattacacacgcatcgatacagaagaaaacctcttcgaaggcaaaatagcgtcaatacctacatggccatcaaatggtgcgattatattcgataacgttagcatgcgatattcaccagatgaaccgccagtacttaagaacttgaatattgttatccaaagtggatggaaggtgggcatcgtcggccggactggcgcaggcaaatcttcgcttatatcagccttgtttagattcgcttacattgatggtacaatcaccatcggtaacatagatacagctttggttgctagacaggaactccggtcaaagatctcgataatccctcaagagccagtgcttttctcagctaccatcagatataatttagatcctttcaatatctatagcgacgctgatatctggagagctcttgaacaggtggatatgaagggtgcagtgccatcattggatttcaaagtgacagaaggaggtgctaacttctcggtgggccagcgacagctgctctgcctcgccagggctgttcttagatcaaacaagttgctgatcatggatgaagcaactgcgaacgtggatcctcagactgacagtttcattcagcaaacgatcagaacacattttgcttcatgcacagtgctcaccatagcccaccgtcttaatactataatggactcagatagagtactggtcatgggcgcgggccaagttctagagtttgatcacccgttcatcttactatcggacgctaacggccatctcacgtcaatggtcaaagagacaggggaaaagaatgctaatcaacttctggaagttgcaagagaagcttacttccaaagcaatatgaaagaaaatgcaagataa

SEQ ID NO: 151 - DNA, 5196 bp, Diabrotica virgifera virgifera
atgtatgcaactgcagctcgtgtttctacaagaaaaataaggacattgctgagatcttcaaaagaaagaataatgggagaaaaattggataaatttttgttgttaatgtggaagaattggctgctgcaatatagaaaaccaattcaaaccataatagaaattgtcgctcctgttctcttttcattccttttagtctacatcagaagtttgtcggatccgacatatgaacatgaaagaatatataagccattttgtgctttcgagggaaacttcaaccttagcctaccgcttttttgtaatgacccagatgctgtgcaagcaggaccatcattatttagtaatatgcaagctggtgatagcaatttcagccttacaatattatatactgctccagaagataaatactacgacgatgtaataggcttctttaagttaataccaaaagtcaacactcagcgtgtaataagctcaggcgaattagaaagaatatcattagctggaaactcatcctattatggtatcgagtttggaggggatagagacaatgtagaggttaatataagatttccaggagaaacagtgtatcaattagattcgattggacgtcaaaattggaggaccaacttagtgtaccccgtatttcaaagctctggtccaagatcccccgacaatgctactggatcagcaccaaattattttgctgaaggatttctggccgtacaacattttgtgactactgctcttcttctagcagataagggtattacacacgacgatccacagggaatgtttaattttttgatggacgcgtctaatccatttcctctcatacagatgcaacgttttccattcgcaagttggttcagtgaccaacttctaacagcgcttacgagcatgcttggaatgattgtcatgcttagttttgtctacacttgtataaatacagtcaaatctatcaccacagaaaaagaaaaacagttaaaggaatcaatgaaaattatgggacttcctaattggctacattggttggcttggtttgtcaagtgctttatttttgttataatttcggtagcacttatggtagtacttctcaaagtaaggtggtactcgaatacagaatttactgtatttacctatgcagacccatttgttttgtttgtatttctcctgctatattgttgctctatgatcactttttgctttgctctgagcgtcttcttttccaaagcaaatactgcagcaactatggcaggtttggcatggttcatatcttatgctccttatctcttcatgcagaataactacactgatcttgcattatctactaagctattaacaagtttgttgccaaatactgctatggcttttggatttcaagttgtacttatgtatgaaggaactggagatggtgtgacctggagcactctgtttaaaccaaacaccccagatgacaccttgagcctgggattaatatggataatgatcataataaacacaataatctacctattaattgctctctacatagaggcagtatttccaggagaatatggagtagctgaaaaatggtacttcccattcacaaagaaatactggtgtggaaaaggagctgtatcagattataataactataatgatcattcagcaaatgaattctttgaaaccgaaccaaaccttagacctgggattcagatattcaatctgaaaaaagcttttggcaagaaaacggctgtacggaatctaagcttaaatatgtttgaaaatcaaatcacagttttgttgggtcacaacggagctggaaaaactacgacgatgtccatgttaacaggaatgataagcccaacaaacggcacagcaaaaatcaatggtcatgatatccggttagacatcgcaggagtcaggaatagcttgggcctttgtccacaacacaacatcattttcgacgagctcaccgtcgaagagcacttgtacttcttcagcaaactcaaaggtttgtctaaaagcaaaataacagcagaaatagataaatacgtcaagctgcttgatctggagccaaagaggaaggagaaatccagtactctatcagggggaatgaaaagaaaactttgtgttggaatggccttgtgtggaaattcgaaggttgttatgttggacgaacctactgctggaatggatccatcagcgagacgagtgttgtgggaattattacagaaacaaaaagagggtcgaacaatattgctcagtacacattttatggacgaagctgatcttttaggagatagaatagcaatcatggctggtggagaattacaatgctgtggatccagcttcttcttgaagaagaagtacggtgcgggatacagtcttattatggataaagcgaaaacttgcaatccacataaagttacagaactgctgaagaagtttataccagagatagagatccatagcaatgttggaagtgaactaacttacttgttatctgaaaataatgctcctgtattcgaagcaatgttaaaacaaatagaacaagaatcaaatgaacttggaatcaggagctatggtatttctttaaccactatggaagaagttttcatgaaagttggtgcagaccatggacaagaagaaatttacaatgaaaaacagaaaaaggacaaaaaagaaaaaaatcctatactcacttctgctgatttaggtccagaatctttatctccctcgtacactggtggtttacatttgattgtcaatcagttcgtcgcaatgcttatgaagaagattataggaacctttagatcatgggttttgttggcgattcagatatttttgcctatgataaacgttattatagttatgagtgtaccttcaggaagtgttccctctgttttgccggcaatgcctttaaatttagcaagattcactgaccctattactttaattgagcgatttgacgatccacaaaattatacgaataacttctacggtgttttaaatggatatggaatgtctccaacaaatattgacaatattacccgtataatgttagacctgactgcaactaatccaaacgtagtgcgtagaagttacattataggatcaactttcacagagcaagaatttgaatttggtatcatcaagacaattcatcctgttattacggcatggtttaacaatgatccttaccactcacctggtattgccttaggcatggctttgtcttccgtttacaatcactacactaacggacatattgaatttgttaacaaaccattaccttttaaagctgcaacccaaatagacaacattgttggtggacaatctcagggattccagtttgcatttaatattggattcagtatggcgtttatctcatcattttatgttatattcttgataagagaaaacgtatccaagtcaaaacacctgcagtttgtatcaggagtgaaggtttacattttttggtttgttaatataatttgtgatatgtttgtctacttactggtatgttcagtattattgatcactatatattgtttccaacaagatgggtttaagacaagtggagatatgggtcggctatttttcctattacttttgtttggttggtcgtttatgccaatttattatgtagcatcattaatattcacagttccatcgacgggttacacaaggatgactctcgtgggtatatttatagggaatgcagcttttcttttagttgaagtgcttaaaacgcaaagcacaaacctaaaacgtataggagaaaccttggataacgtttttcttgtgttcccgcactattctttagctacaggaataaacaaatgctacgctatctattcatacaacactctttgtgaaacagtatttgactcgtgtgctcaaaataattttactaaagatgagtgcatttcaaaatttccatccactgtcgctgatatttgtaccaatcttaacgacaactacttttcatggaacaataatggtatcgcaaaaaatgtaacgtactcactgatttctggtgtcttgtggtcaatattactatttatcatcgaatacaaattcatagccagactgatgtactacatcaaccaaaaattcttcccgaaacaaccaattctcattcaagacgaagacgacgacgtatccaaagaaaaagaaaggattcacatggccacagatcatgatatacgtcaaactaacattttagtcgtgaaagatttaaccaaatactacaacaactttttagctgtgaatgggttgtctattggaattgaaaagtctgagtgctttggtttgttgggtattaatggtgcaggaaaaactacaacatttaaaatgatgagcggagatgaaactgtatcttacggtgatgcatggatcgaaggaaagagtgtaaaaactcaactgaagcaagtacaacggaacatcggctactgtcctcaattcgacgctttgctggatgatatgacagcaagagaaacaattatcatgtactgcctactcagaggaatagagtttaaaagaacccaaagaattgcgaatttcttgtctcgagacttcgattttcatcgtcatttggacaagaaagttaaagagatgagcggtggaaataagaggaagttaagtactgttttgtcgttgataggggatccgccagtactatttttggacgaacctacaacaggtatggatccagcaacgaaacgttacctgtgggattcattatgcaaaattcgagacaacggcaagtgcatcgttttaacttctcacagcatggaagaatgtgaagccttgtgcactcgaatagccattatggtgaacggcaatttcaaatgtcttggatccacacagcatcttaaaaacaaatttgcggagggatacaccttaaccataaaactaaagaaattgccagagagcggtggtctggtacatgcagatacagagtcactggagaagtatatcaaagataaatttccttatgctcatcttagagagaaacatcaagaactattgtattattatataaccgacacttccatggcatggtccactatgtttggtatattagaaagagctaagcgaagtgatctgaatattgaagactattctttgggacaaagtagtctagaacaggtattcctaacgtttacaaaacaccaaaatccagaaggtgacgatgttaagaagaagaattag

SEQ ID NO: 152 - DNA, 4665 bp, Diabrotica virgifera virgifera
atggcaaacttaacagaattaaccaccctcccgacaactgtaaccgaattaccaaaattaactagcaactcctcacaacaaaatgcaactattgaagaagaagcttatgcagcgttgagttcattttgtggatctcctttttgggacacaaacctaacatggaacacaaacgacccagagttcacaccgtgtttcgagaaaactgtactagtatggataccgtgtatttttctatgggtcttcgccggcctagaagtattttacatattcaacagcaaacgacgcaatataccatggaactggttaaatttatcaaaattagcaataacagccactctaatagttttaacaattagtgatatagtaaactcattcaaaacggcaggtaacagaggcagcgaagtgaatgatgtggatatttactcgccgttgatcaaaatactaacatttgcccttaccggagtttttattttctacaatagaaagcacggtctacaaacgtccggactgttattcttgttctggttcttcgtcgtcctttgtgccattcctcagttcaggaccgaaatcagaagaagccaaaggaacgagatattgcccgattattactatttttacaccagctacctgatatattttcctctggtcgtgttgatgtttcttcttaactgtttcgcggacaaggcacctttggaaaggaagtatccacaatcacagaatccgtcaccagaagagagtgccagcttcttatcacgtctactcttcgcatggttcgacccgctggcttggaaaggtttcagaaaacctttagaaaccaaagacctgtgggatatcaatgtcgaagatagttcgagggagttggtacccgtttttgaaaaatattggagtcaaactttaaaaaaagccgaaagcacctcccccacacaagttgcccatgccaaatttaaatcagattcggccagcgtcgatttcgttaataacaagaagaagaaacaagcctccatcttaccggcactgttcaaatgtttcggacctatctatttctttggagcgctgttgaagttgatacaagatctgctcacttttgtgagcccccagattttaggtttccttatttcctacactcgattcaaccaagaaatgtggaagggttacctctacgctgttctacttttcatcacagccaccattcaaacccttttcctagctcagtacttcaacaggatgtttgtggttggaatgaggatccgtactgtcttggtatcaacgatttacagaaaagcattgaagatatcaaacagtgcccgaaaagaaagcacagtaggagaaatcgttaatctgatggctgttgatgctcaaaaattcatggatctaattggttacctcaacatgatttggtctgcaccactacagatctgcctgtccttatatttcctctggaaggaactaggaccttctgtactcgccggacttgctgtgatgataatactgattcccgtcaatggattcattgctaacaagatcaaaaaactacaagtgaaacagatgaagaacaaggatgaacgtgtcaagctgatgaacgaaattttgaacgggattaaagttttgaagctgtacgcttgggaacacagttttgaggatcaagtattgaaaatcagaaataaagaaattaaagtgttgaaacaagctgcttatttgaatgctggtacgtcgttcatctggtcttgtgctccattcctggtctctctagtcactttcgctacatacgtattggtggatgaaaaacatgtattagacgcaaataaagcctatgtttctatctctctattcaatatcatacgatttccactcagcatgttgcccatgatgttgtcaaatttagtacaaacttgggtgtcagttaaaagaataaacaaattcatgaatgctgaagaacttgatcctgataatgttctgcacgaaccctctgaagagccacttacgatcgaaaacggcacattctcctggggcgaaggaccaatcttgaaggacatcaacattaacatcaagaaaaaaactctaacggccatcgtcggaacagtcggttcaggaaaatccagtttgatctcagcgttcctaggagaaatggacaaactctcaggccgtgtgaactcatatggaaaagtcgcttacgtctcccagcaagcttggatccagaacgccacccttcgagataacatcctcttcggaaaaccctacgacaaaacgctgtatgacgcagtggtggaagcttgtgccctgaatccagatctggagatgttgccggctggtgatcagacggaaatcggcgaaaaaggtatcaatttatctggaggtcaaaaacaacgtgttagcgtcgccagagcagtctactcgaatgctgatatatactttttggatgatccgttgagtgctgtagatagtcacgttggaaaacacatattcgaaaaggtgatcggtccccatggattgctaaaaagcaaaaccaaaatcctcgtcacacacggaatcacgtatttgccacaaactgaaaaaatcatcgttctgaaagacggtagaatttccgagacgggaacatatcaggaactcctggatagaaaaggagcattcgccgaattccttctccaacatattacagaagaagccgaaaccgaagcagaactcgatgaactcaaagaccaactcgctgacacaccattatctcaagaagtagcaagacaactagtcaggcacaggtctcgcgtctcagaatctcaatcagaaacaggctccgaccacatcggcaacggatctatccaacgcctcaacagcgtggacaaaagcaaccacaaactatccatagatgacggtaagaaaggtccaaagaaaggcgagaagctaatagaaaccgagaaagcagaaacgggcaacgtcagctgggccgtctacaagcattacttgaagtctatcggattggtgtttatgttggccaccttgatttttaatttagtgtaccaaggtttcagtgtcggctccaacgtttggttggggctttggtcagatgatcaaaagatcgtcgtcaacgataccgttgacactgcaagacgagatatgtatctcggggtgtatggtgctctaggtcttggacaagcaattcctgcaatatttaccgacgtatcactacaactgggttgctttgcagcagcagttataatgcacaaaaagttactctctggggttcttagatcaccgatggcatttttcgatactgttcctattgggcgcatattagcaagattctcaaaagacgttgaaactgtggatcacgatttgccttggtttttttcagacacatgtttctgtgtattcgaggtcgtaggtactctagctgtaatcagctattccacaccagtgtttattttagtgataatccccttatgtttcatttactacttcatgcaaaggttctacgtggctacctctagacaagtaaagaggttagaatctgtgtcacgttccccgatttattcgcactttggagaaagtgtctctggagcacatgctatcagagcgtacaatcaacaggaaagatttattgtggaatcggaaaacaaagtggatatgaatcaaatatgttattatcccggaattatatcgaatagatggttggcagtcaggctcgaaatgattggaaacttaattatatttttcgctgctctgttcgctgttctcaagaaagatcaggcgccaggattggtcggtctttctgtgacctattcgctacagattacacaaacactcaactggctggtcagaatgacgtctgatgtggaaaccaacatcgttgccgtcgaaagaattaaagagtacggagaagccccgcaggaagccgcttgggaaatccctagcaagcagacgtccccagcctggccggaagaaggtacagtccaattcaaaaactattcggtcagatatagacccggtttggatctcgtgttgcacgatctggacttcgaaatcaagggtggagagaaggttggtattgtaggaagaactggagcaggaaaatcgagtctaacgttggctttattcagaataatcgaagctgcgcaaggaaacatcctaatcgatggaatccgcatcgacgaacttggtttacacactcttcgttctagacttactattatccctcaagatgccgtactgttttctggaaccctacgtatcaatttggacccattcaacaaacacagcgatgaagacgtatggaggtccttggaacatgcgcatcttaaagaattcgtgaaaggactaccagctggccttaatcacgaagtcaccgaaggcggtgaaaatctgtcagtcggccaaagacagctaatctgcctcgccagagctctactccgaaaaacgaaaattctcatcttggacgaagccacagcagcagtagatttagaaacggacgatctcattcaaaagacaatcagaacggagttcaaagaatgcacagtacttaccatcgcacatagattaaacacgatcatggactcagacagagtcatcgtgctagataaaggcaggatagcagaattcgacagccctgcgcgactgctagccaatgagaattcaatatttgccagtatgtcgagagacgccggtttagcttaa

SEQ ID NO: 153 - DNA, 5229 bp, Helicoverpa zea
atgagattagaaacgaggcacgctagtgccgccaccaagttccgcctgctcatgtggaagaactttctgcagcaatggagacatcggctacaaactgtcgtagagctactattgccagtcgtgacaatggcgctggtgctcatccttcggtggcagataccgccttatcaaatcgatacactcacttaccccgcgttgccagcgcacacactcaactactctaccaatatcctttttgccatgaatatggaagaattatcaattgcatactccccggcaagtccagtgttagatgatgtaatgagaactgctgttattaatttactaacagccaatatgaaagatctgattcctatttttattgataacttaccaccggggatagccaatataacatttccaccagatatgaacttaaatacgtcggccattgaggagttcgtgaagtcacgaatacgagtcgtaccttataacagcagttatgaaataagagggatctacgttgacgaagaaactacacgcagcattatcgctgccgtcgagtttgacgataaactatatggagcagaacagttgtcaaataatttatcttattcgctacgttttcctgagagaccccgtctcaattcgtttttccaaactggagggcgcacctggagatctgacggagtattcccggttttcgaagtgcctgggcctagatttcctcactcgtgggaaggtggtaatgacccaggttacgttaacgaaatgttcgtggcacttcaacaagttatttccatggagctggtatcaagggcaaccgggttggacttgaagtcatttagggtgaacatacagaggtacccgcacccgccgtaccttcacgaccagtcagtggatctgctgcaatttatgttccccctgttcatcatgttgagcttcagctacactgctgtcaacattgcacgggcggtcacagttgagaaggaattgcaattaaaggaaactatgaaaattatgggcctccccacatggttgcactggacagcatggtttgttaaacagtttatctacctatcaatcacagctgttctgctagttgtgttgctaaaggtaaattggtttactaacgacgatggcttcagcgaatatgctgtatttactaatacaccttggacggttttgctattcttcttgatactgtatttatcttgcgcgatatttttttctttcatggtaagcagtatattttcaaaaggtagtacggccgcgttgtttatggcggtggcatggttcctcacttacatccctgctttcctcctggccatggatatcaatatgtcgactgcggtgcaggtcatcacatgcttcagtattaactctgcgatgtcctatggtttccaactaatgctcgctaaggaaagcactggagggctgcagtggggcgacttcatgacgtcaccagggacggacaccacgcgcttcgtgttcggccacgtggtcatcatgctggtagtggactgcctcatctacatgctgatcaccctctaccttgaacaagtgctaccaggccccttcgggactcccaaaccttggtacttccccttccagttgcagttctggttcccaaattataaatcgaaagatgctggattaattttcgaaaatgataatagtgaattcgatgatattataaaagaaaaggatcccacagaccacgaagttggtgttaaaatgcaaaatttaacaaaaatctttgggaataacatagctgttaacaatttatctttgaatatctatgacgaccaaatcacagttttacttggtcataatggtgctggcaaatcaactacaatatctatgttaacaggaaatttaaaggtaactcgcgggacagtgaacgttgccggatatgatatgacttctcaaagctccgcagcccgttcccacattggattgtgtcctcagcacaatatactgtttaacgaactcacggtcaaagaacatttggaattctttgctagactaaaaggatttaaaggcaaagaactgtatgaagagatagactcacttattgaaaaattggaactacaggagaagcgtgactacccctcaaaaggtctgtcaggaggtcagaagcgtcgtctttgtgttggtattgctctgagtggggcggcacgagtggtcttactcgacgaacctacgtctggcatggatccttcatctcgtcgagcactgtgggaactcttacagaaggaaaagaaaggtcgctcgatgatcctgacgactcattttatggacgaagcagatattctcggcgacagagtggctataatggcaaacggtagactgcaatgcgtgggctctccgtatttcctcaaacgtcattatggcgtcgggtataccctggtgatcgttaaggacacagacttcgactttgtgaaatgctccgtacttatcaatagctatattcctggtactattgttaaagaagatcgaggaacggaaatcacttataatttggtaaacgattactcacacgtttttgaagaaatgttgaatgatttggaaagaaatattgataacatcaaatttaaaaactatggtttagttgctactacattagaagatgtctttatgtccgttggtgcagacttaagtccaattaattccgaatctgacgatgctattactactactactgactcgactatcgatgatatattaaaacaagaaatcgattcatctttggaagaactggataaggacgagagtaacgtgacgggcctccgcttgttcggtcagcaagtgctggctgtatggatgaagcagtggctggtgctgatccgctcgccatgggtcatggtactgcagtttttggcgccagtggtactcatcaactccacgctaggagttctgcgttacgtcatgtctttatcaccgaccattagaactaggtggttgtcgttggaagaagggtatacggaaagcgaaactctgctcagcttcaacggtagtgtagcgtcatcagtgggtgccctagccgcgcaagcataccaaagcctgttcgccaattctggagttatggacatggaaatcaacgctatcggaagccagccaatagaagaatattatctaaatagaacaagtgatcccgttgtgatgggttcgctgcggcaccgcttgctgataggctccacatttgacgacaactctgctaccgcctggttcagtaactttggctaccacgatgttgctacatcgcttgcggcaatccactcagctattctcagatctaaaaactctgatgcagtactcaatgtatataatcatccgttggaagcttcgtatatagatcagagtgacgtgcagactatgatagctatgttgtccatgcagttgtcctctggcatcggcagtagtgtgagcattgttagtgcggttttcatcatgttttatatcaaggaacgtatgtcgggggcaaaacttctacaaaatgcagcaggcgtggcgccttctgtgctgtggggcggcgcagcgatcttcaattggttttggttcctcatcacttgtgtttccatcgtcatctcgtgcgtcgcttttgatgtcatcgggttatcgaacgtgcatgaattaggtcgaatgtttttgtgcgtcatggtatacggtgcggcgatgttgccattagtgtaccttttgtcgcttaagttcaagggaccagctgtcggcttcgtgggcttctatttcctcaacgtgcttttcggtatgatgggagcgcaggtggtggaggcactatcctctcctatgctggacacagagcaagccgcccacatccttgactacttactgcagttctacccgctttacagtcttgtcacttctatcaggtttttaaatcaagtcggcctacgggagtatacttgcttacaaggctgtgaatacttgcaggcagtatacccgaatctagagtgtagcatggcaagcatgtgcgaattccacagtaactgctgcgttcgtgaaaacccatacttcgattgggaggaaccaggcgtcctgaggtacttgctcagtatgtgcttctcctgcctaatcttctggttgctgcttatgaccattgaatacagagtggtgcaaaaggtgttcacattcaagaagactcctcctccaatagacgagagcacgttagacgaggacgtgatgacagaggcgaggcgcgcgcgccaggtgccgccgacacgccgcagcgaccacgcgcttctcgctcacgacctctccaagtactacgggaaacatctcgccgtagaccaagtctcgtttagtgtgaacgacggcgaatgcttcggtctattgggtgtgaatggtgccggaaaaacgaccaccttcaagatgctgatgggtgatgagtccatttcaagcggcgaggcgtatgtctccgggcactcggtgcagaggaatctcgatagagtacacgagaatattggatattgtccgcaatttgacgcattatttggtgagctgacgggtcgccagacactacacatgtttgcgttgatgcgcggcttgcgtttacgcactgcagcaccttcggctgaaacactcgcacatgcgcttggcttcttcaaacatcttgataaaagggtgcatcagtattcaggcggcacgaaacgcaagcttaacacggcgatagcattcatgggacgaacacggcttgtgtttgttgatgagcctaccactggagttgatcccgccgctaaacgccacgtatggcgcgctacccgcggcgtgcagcgagcaggtcgcggcgtggtgctgacgtcacatagtatggaggagtgcgaggcgttgtgttcgcgactgaccatcatggtcaacggtcgcttccagtgtctgggaacgccacaacatctcaagaacaaattttctcaaggctttactttaatcattaaaatgaaaactgacgacagtgacagcgacacgcagtcagtaaacagcactaccagcgtagtagatagtgtcaaactatacgtctctgggaactttgaaagtccaaagataatggaagagtatcatggtcttctaacttactacttgcctgaccgtagcatggcatggtcacgaatgtttggtatcatggagcgcgccaaacagatcttacaaattgaggactacagcatatcgcagactaccctcgaacaaatattcttgcagttcaccaaataccaaagagaagaaggaacgacgttataa

SEQ ID NO: 154 - DNA, 3801 bp, Helicoverpa zea
atgaaggactccgacggaaatgggcggcaactgaaaccaggtgacaaggagaatggcaacaagttgccagaccctttaaatggagagttcccgaaaggaaaagactcggacacaagttcagaagccgatagcaaggcagatgaagtcccaagcatagcatttattacactgttcagattcgcgacgaaaaaggacaaaatattcatagtttgtgcgttaatatgctcagtagtggcagcatgttctacgccaatcaacacattactgctagcgttcttactagatgctatggtagagtatggaagttctatcagagatgggacaccggaccctgacaccttcttagaagcattgatgttctttgctatttacaacaccgtcactggagtcgtgctcatcatcctctcgtatgccgccaccgtgctgatgaatatagccgcatatcaccaagtacatgtaatacgacaagaatacttaaaagcagcactaaatcaagattttgcgtattacgatatacataagaacgctgacatagcttccaaaattaacagcgatgtagtgaaactagaagatggtataggcgaaaagctggccactttcgtgttctaccaggcagctttcttcagtagtgtcatcatggctcttgtcaaaggatggaagctggctctgctatgtctcatatcattccctgtcactttgacgcttgtcggtgtcgctggactggttggtgccagatttggtaagaaagaggccatagcctccggcaaggctggtgccatagccgaggaagttatatctgccatacgtacagtgtacgccttcagcggccagtccaaggagatggtgaggtacgagggacatctcagagaagccaggaaaatcaacatcaagaaaggcttcttcaacggcctggccatgggactgttattcttctgtatcttctgcgcatatgccctttccttctggttcggctacaggctgttgtccactgatgatgactatgatatttctactatgatagcggtattcttcggtgtgatgactggttcggcaaacttcggcatatcgtcgactttgatggaggtgttcgggtctgcccgaggcgcaggggcccagatctttaacatgatcgacaatattcccactattaaccccctgctgaatagaggaacaacgccccctaatattcaaggaaacatcgagttgaagaacgttattttccattacccatccagacctgacgttccggtactgaagggaataaatatcagcgtgaaacgaggccagtctgtggcattggtcggccactccggctgcgggaagtctaccatcatacagctgatctctaggttctatgacgtcattgatggcagtgtggcaatcgacgggcatgatgtccgcgacttatctgtccgatggctgcgagaccaaatcggtctcgtgggacaagaacccgtacttttcaacaccacagtcagggagaacattcgctatgggcgtgagaactgcaccaatgaggagattgaagcctgcgctagacaggctaacgcgcatcagttcattatgagactgccgaagggttacgatacattagtcggagaacgaggagcgtctttgtcaggaggtcagaaacagcgtattgctattgcgcgtgcactcgtgaggaaccccaaaatactgctattggacgaggccactagtgctcttgatacctcttcagaggccagagtacagaaggctctcgataaggctcaaaaaggtcgcacaactctagtggtagctcacagattgtcgaccatccgaaatgtggatgtcatatacgtattcaagagcggtgtagtggttgaacgcggcaaccatgacgagctgatgtcgcagaagggacattactatgatatggtcatgctgcagaacctaggagctgaagatactaatgataagtcaagactcatgcgggaaacgtcggaaacaagtgtagaggacgaagaggatgaagaagaatttctcgattttaaaactggagacacagaagacgatgtggacaacgttccagacatttcgttctggagagttctgcggctcaacaagccggagtggaagagcgtcagtctcgccagtatttgttcgctcatgagtggcttcagtatgcctctgttcgctgtcatatttggagacttcctcgccattctatctgacccggaccctgctgtggttttgaatgaagtgcgtaaaatcgcgttgatatttgtcggcattggtgtcttctctggaatcactaacttcatcgtggtattcttctacggtattgcgggcgaatacttgacggagaggctgcggcagatgatgttcaagaaactgctagaacaagaggtcggcttctatgatgacaaggacaactcgactggagctctttgtgcgcgactgtccggcgaagctgctactgtgcaaggagctaccggccaaaggattggcacagtggtccaagcagtaggaacgtttggtttcgcgctagtactatctctggtgtacgagtggcgcgtgggactggtggcgctgaccttcgtgcctgtcatcgttttcgtgttgtataagcaaggcaggatgacatataaggcctcctttggaactgctaagactatggagaagagttctaagattgctgtggaagccgtagccaacgttcggacagtagcatccttgggtcgcgaggacaccttccgacgggaatacgagaagcagttgaaccccgcactgcaggaggccatcaaggcctcgcactaccgaggcctcgtgttcggtctctctagaggaatattcaacttcgtgatcgccgcgtcgctgtactacggaggaacgctcattgttagcgaggacatcccctacgacgtggtgtttaagtctgcacaagccctattgatgggatcatcgtcggccgcacaagcgtttgcgttcgcgccgaacttccagaagggaatcaaggcggccggccgcatcatcatgctgctcaaccgacagtccaaaatcacggaccccgtgcgacctgctgtacataactttaaaggcacaggtgaagccagtctccaaggcatcaagttctgctacccgacgcggccgatgatacaggttctcaaaggcttgcagttggagatacagcgcggcaagacgcttgccctcgtcggcgccagcggctgcgggaagagcactgttatacagctgctcgagagatactatgatcctgatgagggtatagtggctcaagacggcgtacctctcccgaagctgcgcctcgtagacagtcgtcgcgcgatcggcttcgtgcaacaagagccgattctattcgatcgcaccatcggcgagaatatcgcgtacggcaacaacgagcagaaagtcacgcaggacgaaatcatacaggctgctaaacaggctaacatacacaactttatttcgtcactgccgctgggctacgacacaaacatcggcgctaaaggcacacagttgtcgggcggacagaagcagcgcgtggctatcgctcgtgctctcatacgcagacccaagatgttgctgctcgacgaggccaccagcgcacttgatactgagagcgaaaaggtggtacaagaagccctagacgcagctaaagctggtcgcacatgcgtgatgatcgcgcatagactgagcacagttcgcgacgctgacgtcatctgcgtcatacacgacggcttagtcgcagaaaccggcacccacacagaactcatagagcgcaaggggctctactacaacctcaatagaagaggctacgcttaa

SEQ ID NO: 155 - DNA, 3786 bp, Pseudoplusia includens
atgaaggattccgagaatggatggaagcaaaaacctggagacggggatattcggcacagaataccagacctcgacaagggagaatttgcgaaggataaaaacaatgacacatattcagaaccagaagaaaaagacgatgaagtcccgagtatatcatttattaccctgttcagatttgcgaccaaaatggacaaatgtttcatgttcttcgcaattatattctccatgatcgctgcctgttcaacgcctattaacactctgttgttggccttcttgctcgaagccatggtagaattcggcaagtcggtcatagccggtgcaccagacacggaccagtttatgagtgacttattttggtttgcaatttacaatacgatcactggcgctttactgatcgtactgtcgtatgcagccactactttaatgaacatatcagcttacaaccaggtatacatcattcgacaagaatatttgaaagcagctctgaatcaggactttggatacttcgatatccacaaaaatggtgacatagcgtctaaagtaaacagtgacgttgtgaagttagaagacggaataggcgagaaactggccaccttcatcttctaccaggcttcgttcttcagctccgtcatcatggccctcatcaagggctggaagctggctctcctctgcctcatatcattcccggtcactatgacacttgtgggggttgctggactggtggcttcaaggctctccaagaaagaagccgtagcttcaggcaaggctggtgccattgccgaggaggtcatatcagctatccgcacggtgtacgccttcagcggacagggccaggaaattatgagatacgatgaacatctcaaggatgctaggaaaatcaatattaagaaaggcctgttcaacggcttggcgatgggactgctcttcttctgcatcttctgcgcctacgctctttccttctggtttggataccagctcatgcaaaccgatgactacgatgtatctacgatgattgctgtattcttcggtgtgatgacgggatctgctaacttcggtatttcgtcgacgttgatggaagtgttcggtgtcgcccgaggggcgggcgctcagatcttccacataattgacaacgttcccaccatcaaccctctgctgaacaagggaacagctcccgcttctattgaaggcagcattgagctgaagaacgttgtgttccactacccgtccaggcctgatgttcctgtactgaaaggtgtcagtataagcgttcagcgaggccaatctgtggcactggtgggccactccggctgcggcaagtccaccatcatacagctgatctccagattctatgacgtcatcgatggttctgtcgccgtagatggtcacgatgtccgtaacctgcaagtccgttggttacgtgagcagattggtctggtgggccaggagcccgtgctgttcaacaccacggtccgcgagaacattcgctacggacgcgaggacgccagcaacgaggagatcgagaaatgcgccagacaggccaacgctcaccactttattatgaaactgcctaagggttacgacacactggtcggcgagcgaggagcttcactatcaggaggtcagaaacagcgcattgctattgctcgtgctttagtccggaacccgaagatcttactgttggacgaggctaccagcgcgctcgatacttcttcagaagctaaagtacaaaaggcccttgatagagctcaagaaggtcgcaccacaatcgtagtagcacacaggttatcaacaatcaggaacgtggatgtgatatacgtgttcaagggcggcaacgtggtggagagcggtagccatgacctgctgatgtcgcagaaaggtcactactatgacatggtcatgttacagaacttgggtgcagaggaaaatacagagtctaaaggcttgagccgcgaacaatcagtgagaagtgaaaaggaagatgaagatgactttttgggaaatgctgctgatcctgaggaagatgacgaggccgctccggacgtgccattcaccactgtactgaaactgaactccccggagtggaagagcgtgactgctgccagtgtctgctctctgctcagcggctttgcgatgcccctcctcgctgttatcttcggagactttattggtgttctctccagcccggacgatgatgaaattttggcatctgtgagacgatatgctttgatctttgttggtattggcgtattctcgggaatcaccaatttcatagtggtgttcctatacggtatagctggagaatatctaacagaacggcttcgaagacaaatgttcgagaagcttctacagcaagaagtcgcgttttacgacgacaagaacaactcgactggtgcgctctgcgctcgtttgtctggtgaagcagccgctgtgcaaggggcaactggacaaagaatcggcacagttcttcaggcgctgggcacattcggcttcgctttagtcttatcactgatctacgagtggcgagtgggattggtcgccctgacctttgtcccgatcatcaccttcgtcctctacaaacaaggaagaatgacctatgctgagtctgctggaacagcgaaaactatggaagctagctcaaagattgctgtagaggcagtagccaacgtccgtaccgtggcctccctgggcagggaagacaccttccgcaaagagtacgctaagcagctgctccccgccctagtcatggccaagcggtccactcactggcgaggcatcgtcttcggcctgtcccgaggcatcttcaacttcgtcatagcatcgtccctatactacggaggaacgctcatcgtttcagagggactcgattactctgtagttttcaagtcagctcaagctctgctcatgggcgcgtcatcggctgcgcaggcgtttgcttttgccccgaatttccagaaaggcatcaaggcggcgggacgtgtcatcaacctgctgaaccgtcagtccaagatcactgaccctgcacacccagcttatcccgccttcaaaggaactggtgaggcaagccttcagaacgtgcagttcagatatcccactcgtccgatggtgcaagtcctgaagagcttgaacctggagatcgagagagggaagactctggcgctggtgggggccagcggctgcgggaagagtactgtcatacagctgctcgagagatactacgatcccgaagggggtattgtggctcaagacggcgtgcctctcacgaaactgcgtctgatagattcgcggagagcgatcggcttcgtgcagcaggagcccatcctgttcgaccgcaccatcggcgagaacatcgcgtacggcaacaacgagaagaacgtcactgctgacgaagtcatcgacgcggccaagcaggctaacatacacaactttattacctcgctgcctttgggttacgagactaacatcggatctaaaggcacgcaactgtcgggcggtcagaagcagagggtagcaattgccagggctctgattcgacgccccaagatgttactgctggacgaagccactagcgccctcgacacagagagtgaaaaggtggtgcaagaagcgctggatgctgcgaaggcgggtcgcacgtgcgtcatgatcgctcatcgcctcagcaccgtgcgtgacgctgacgtcatctgcgtcattcacgacggccaggtcgcggaaatgggcacacacgacgaactcatcaaactcaaaggcctatactataatcttaatagaagaggatatgcgtaa

SEQ ID NO: 156 - DNA, 4035 bp, Pseudoplusia includens
atggaaagtgaaattaaaaatccacaaatttccattaatgtactgccagctccagaaactcctaaaaagaggcacaaacccaatatattttcgactatatttatttggtggatgtgtccggtgctcataaacggcaacaaaagagacgtagaggaagaagatttaataacacccagtaaagcttatgattcagaaagacaaggcgactattttgaaaggtattggttggctgaagtggaacgtgcggcgagtgagaacagagagccgtcgctatggtcagctatgcggagagcgtactgggtgcagtacatgccttcagcaatatatatcctgataatcaccacagccaggaccgctcagcccctagtatttgcggagttgctttcgtactggtcagtggacagtaccatgtcgacatatgatgccggcttctacgccctcgccatgttgggcctcaactttatatcgttgatgtgccagcatcataactctctctttgtggtacgattcggtatgaaagtcaaagtagcttgttcatcacttctgtacagaaagttgctccggctgagtcaagtatcagtgggggaagtggcaggcggtaagctggtgaacctgctctcgaatgacatcgcgagatttgactacgccttcatgtttttgcactacttgtggatagtcccgatccaagcggccgtggtgctctacttcttgtacgatgtagctgggtatgctccctttgtcggactcttcggtgttgtgatattcatcttgccacttcaagctgcgctgactaaactcactgctgtaatcagaagaagtaccgctaagaggactgacaagagaatcaaactcatgaatgaaattattaatggaattcaggtcatcaaaatgtacgcttgggagaaacccttccagttggtcgtgaagcttgcgcgagcctatgaaatgactgcccttaaaaaatccatcttcgtgaggagcatgttccttgggtttatgttgttcacagaaagaagtatcatgttcttcacaattttgacacttgcgctcaccggcaccatgatctcagctacaattatctaccccattcaacaatttttcagcataattcaaatgaacgtgacattaatcttgccacttgcaattgccagtttctctgagatgcttgtgtcctgcgagcgtattcaaagtttccttattttggaggaacggtcagatatgcaggtaacaccgaaaataataggagggaaaaacaaattgtttaactcgaagaatggacatttagaaccaggcgacgttttgcctaagaaatacgtgcccagcgaactgtcggttacgaagcctgccgaggaaccagttcaatcagattaccccatagtaataaacagagtaagcgcatcttggaccggcagtaataagcctgaagacgtgacgctcaaaaatataagcatgcgtgtgcgcaagggcaaattgtgtgctgttattggtcctgttggttccggcaaaacatctctactccaattgctattgagagaattaccgttaatggatggtactctgaatgtcaagggaaaactatcctacgcttgccaggaatcttggcttttcccaggcacagttcgagaaaacattttgtttggtctcccttacgacgtgactagatataaagaggtttgcaaagcggcctgcttggtaccagattttaagcagttcccgtatggtgacctgtctctggtgggagagcgaggagtgtctttgtctggtgggcagagggctaggatcaacttagctagagcgatataccgcgaggctgatatttacctgctagacgacccgctatcggcagtagacgccaatgtgggcagacagctgttcgatggatgcatcaagggctacttggcggggcgcacgtgtgtgctcgtcactcatcagattcattacctcaaaaccgctgattacatcgtggttctgcatgagggcgctatcgagaacatgggcagctacgatgagcttgcaaaatctggaaccgaattctctaacttgttgtctgatcaagccggcaatagcgatgtcactgatgtcaaaactaatagaccagctatgctgcgaggtatatctaagatatcagtcaagagtcaagaagagcaagatgaagaggaaaaggctcaagttttggaagcagaagagagaggaacgggcagtttgaagtttgaggtcatttggtcatatataaaagctgttcagtcatggactattgtgatactcgcgttggtgtcgctcatgatcacgcagggagcggcaaccacggccgattactggcttagtttctggacaaatcaagtcagcgagtacgaaatatctttagaacccggacaactccctgatactagtttagacgctcaaattggattattgacaacggcccagtatctgatcgttcttggcagtgtaataggaggaataattattatttcacacctccgaatccttgcttttgttgttatgaccatgcgagcttcgcaaaatcttcacaacattatttacgaacagttgattattgcagtgatgagattcttcgataccaatccttcaggacgtgtcttaaatagattttccaaagatatgggtgccatggatgaacttttaccgagaagtattttggaaaccattcagatgtacctctctctcgctagtgtgttgattttgaacgccatagcgttgccgtggacgttgatacccaccgcagtattactggttgtattcgtgttcttcttgaggtggtacatcagtgctgcacaggctgtaaaacgattggagggcacaactaaaagtccggtgttcggaatgataagctcaacgatttcgggactttcaaccattaggagttcagattctcaaaccagactcctaagaacttttgacagtgctcaggaccttcacactagcgccttttatacatttatgggcggttcaacagcatttggaatgtacctagatgccatgtgcttagcttatctcggagttgttttggcaatcttccttttaggagatttcagtgacataattccggtgggtagcgtaggattggcggtgagtcaatctatggtgctgacattgatgttgcaaatggctgctcgattcacagctgatttcctcggacaaatgacagcagtcgagagagtcctcgactacactaagttaccgtcggaggagaacatggagactggaccaaccacacctccaaatgattggcccaaagtagggcaagtggcgttcaataacgtttacttgaactattcgcctgatgacccaccggtactaaagaatttgaatttcgtaatccagagcggttggaaggttggtgttgtcggacgaactggcgctggaaagtcatcgttgatatcggctctgtttcggctgtctaacataacaggtcacatcacaatcgatggtctcgacacggagggaatagctaaaaaggttttgagatcaaaaatatcaataattccacaagagccggtcctgttctcagctacgttgcgatacaatttggatccgtttaacaattacagtgacgaagatatttggagagccttagaacaggtggagctgaaggacggaatacagtcactggaatttaaagtaacggaaggcggcagtaacttctcgatgggacaacgacagctgatatgtttggctagagccgtgttacggtcgaataaaatcctcatcatggacgaagccaccgccaacgtcgatcctcagactgacgctttgatccaaacaacgattcgtcgggagttcgcggcgtgcacggtgctcaccattgctcatcgtctgaacaccatcatggattccgaccgagttctcgtcatggacaagggcgaagccgtggagttcgatcaccctcacatcctactctcagaccctaacagcatcttcagttccatggttagagaaactggagaaaacatggccaaggtcttatttgatgtcgccaagaataaatatgacagcgacaacaaaactgcttaa

SEQ ID NO: 157 - DNA, 4104 bp, Pseudoplusia includens
atgactgaaaaaatgggtacaaaaaaggaagaaaatacgggaacaaaatcgtctcctccgcctcaaccaaagactgttccgaatgtgttgtcacgatcgtttttttgttgggtgttccccttattctacttcggtaacagaagagacttagaagagtatgacctggtgcctccgagacatatctatgattcgaagctggttggcgatcagttggaaagagtttggtatgaagaagaaaagaaagccaagttacaaggaaagacgcccagctttacgagggtattaatcaaaacctttggctggtcgttcctgccagggggtattatacaattcatttctattgctttacgtacggcgtcgcccttgctattcagcgagttgctaaagtactggagcacagagtcggacatgtctcgcgagacggccatgtattacgctatcaccatgatcctgttcaactgggcgtcttcctacgccaaccatcacggcttactgttctgccaacagtttggcatgaagctcagggtcgccacaggctcactaatgtttagaaagattatgcgtatgagcaacggttcgttgggagagacgacggccggtaaggtagtgaacctgctgtccaatgacttgcaaaggtttgacctggcgacgatgttcttgcattacgtgtggatcatcccgatacagctggctgccgtcgtctacctcggctacgttcaggcaggcactgccgctctcatcggttttgcgtccttaatcgtcattgcactgccaattcaaggtgttttaggaaaagccttaggtgctattagattgcgtaccgccgaaaaaaccgacgaaagaattaaattaatgagcgaagttattaacggcattcaggttataaaaatgtacgcatgggagattcctttccaaaaagtggtaggagagaagcgtgccgtggagatgggcgaggtggtgaagggtaccaggctgaggaccgtgttcattggcttcatgcagttcaccgagaggtcagcgctgttcatcactgtactgatgtttatcttgttcgggaactccatgtcagcgaatgtcttctatccgttgcagcagtttatgaatgcggctcagattaacataacgctgttcctgcctcttgtgataaccttcactgcggagctgtatgtgtcgctcgggagagttcaagaattcctatccttacaggaccgaccggacttgtcagaaaagacggagtatattgagtcttccaatttgttccgcaatatgtcgactaaaaggaattccacccagcaagtacgaccgctctcttatcaacagaaatcgaatggatttgccgtcgacgaaatggtggagaagccagtgatcccgtacaacagaaggttctcacgaagcgtgtcggtgcaggaggactgcgcgctgaagctgcacgacgtgtcggccagctggaccggcgaccccaacatgatggccatcaagaacgtctccatgaggctgaggaagggcaagctctgcgctattattggacccgtcggctctggaaagtcctcgattctgcaactactactaaaagaattgcctccggcgtctggcagtgtttcaatatacggccagatctcgtacgcttgccaagaggcgtggctcttccccagcaccgtccgggagaatatacttttcggtctgccttatgaacccgaaaaatacaagaaggtgtgtaaggtgtgtactctggagaaggatttcaagcaattcccgtatggcgaccagacgctggtgggcgagcggggggtgtcgctctccggaggccagcgagccagaatcaatttggcgcgcgctgtgtacagagaagctgacatttacctgcttgacgacccgctgtctgccgtagacgcgaacgtcgggcgtctgctgttcgagggctgcatcaacggttacctgcgcaagcgcacgcgcatcctcgtcacacatcagatacatttcttgaaagctgccgacttcatcgtcgtattgaatgagggtcgtatcgaaaacatgggaacatttgacgagttggttggaagcggcaaagacttcgcgcaaatgctcgctggattacaggagggcaaagacaaagacgcagagagtttgggatcacatgcgagtctcgaagacaagcccaggcctgcgctcaaaacaatggccagtgtgaatgaaggcgaggatctcgaggagtttgaggagcagaagaaagaacaagaggagagatcctcaggcaacctgcgctgggaggttgtcctcacgtactttaaatccggcggcaacctgtgcttcgtactgtttaccgtgggcgtggtactgcttgctgtggccagcggcgcatcggttgactactgggtcagttattggacgaatcagatggcggtccacgacgccaccggcggcggctccaccgactcggattcaggtccaaactttgatgagcaggtgggcttgttcacgaccggccagtacctgatcatccacggctgcctggtcttatcttgcatctttctgaccaacatgcgcgtgtttccattcgctcacctctgcaacacggcttccatcaatctgcataataatatgttctccacaatgctcaggggagtcatgaggttctttgacaccagtgattcaggtcgtatcttgaataggtttacaaaagacatgggtgctttggacgaaatcttgccaaggacgctactagacgttatccagatgtatggatctttggttgcgatctttgttctgaatgccatcgccttgtactggacacttgtaccctccgctgtgttgggtacacttttcttctttatggtccgggtatacaaaaaagcggcgcaaggaattaagcgattggaaggaacaacaaagagtccgatgtttggtgtagtgacatcgtctctcaacggcattgccacgatcagatcgtcgaactcgcaagataggctcatagaacaatttgataccgaccaggatttacatagctctgcatggaactgcttcttgagtggtggagctacgtttggtttctatttggataccatatgtttagtgtatctgacagctgttatatttgtcttcctcttcctcgactttggtgaatcggtcccagtgggcagcgtgggcctggcggtgacgcagagcaacgtactagtcatgttactgccgcacgccgcgagagttctcgtcgagttcttggcccagctcaccagcgtcgagcgaatcctacagtacacgcacatcgataccgagcctaacttattccaaggaaaaatcgatatgccgcccacatggccttctcgaggatcgcttatttttcaaaatgtatccatgcgatatgcgcctactgaggagcctgtactgaaaaacttgaatattgttgtagaaagtggatggaaggttggcatcgtggggcgaacaggagcgggtaaatcttcgttaatatcagccctattcagattcgcgcatatcgaaggatcaatatcgattgatggaatcgatacttcgcttatatcgagacagggcctgcgatcgaaaatttcaattattccgcaagagccaatcttgttctctgcgtctatcagatacaatttagatccgtttaatagctttagtgacgacgacctctggagagctttagaacaggttgatttgaagcccgttattccatccctagatttcaaagtcacagaaggtgggtctaatttctcagtaggccaacggcaacttatgtgtttggcgcgtgctgtgctcagatctaatcagatattggtaatggacgaagccacggcgaacgttgatcctcagactgacaacttcatccaagaaacaatacgacgtaggttcgcgtcatgcactgtgctgacgatagctcaccgcctcaacactatcatggactcggacagagtgctcgtcatgagctctggcgaggtcgcagagtttgatcatccttacgtgttactctccgaccccaatagtcatttctcttccatggtgcgagaaactggtgaaaagaatagtgcaaacctgttgcggatagccaaggacgcttatttccaaagcaatctgaaagaaaatgcgagataa

SEQ ID NO: 158 - DNA, 4908 bp, Spodoptera frugiperda
atgcggctggtaccgaagcaggcgagccccttcgcaaagttccggctgctgatgtggaagaacttcctgcagcaatggaggcacagaacgcaaacagtcctcgaaatactactcccagttctcaccatgacgctggtgctaatcctacgatggcagatagaaccagcagaaagagaaacacaaacctacccgcctttcagagcaaacacactcaacttttccactgttgtactgtttggtctggattgtcctaatgtatctattgcctattcaccaactagtcctgtgttagaagatgtagttagaaatgcaataactaatttattaatacagaacatggaagatttaattgctaggttaccaatagaaatagagttaccacccactattgaaataaattctaccgctatacttgactggataaaatctcgtataagggtacaagcttataataatagtcatgaaacaagagggatttatatagaagaagaaaatacacgaagggttatagcggtcgtagagtttgacgataaactatacggtgcagaatcattgtccaataatttgtcgtactctctgagattccccgagagacctcgtcttaattcgttattccaaactggaggtcgcacttggaggacagacgcagttttccctgttttcgaaacgcctggtcctcgattttcgaagtcttgggaaggtggtaacgatccaggttacgtaaacgaaatgttcatagcactacaacaagttatttcaacggagttgatatcgaggtccacaggagtgaacatgagtgagttcacagtgttcctgcagaggtatcctcacccgccgtacatcagggacatggcgcttgaccttctgcagttcatgttccctatgttcatcatgttgagcttcagttacactgcaatcaacattacaagggcggttacggtggaaaaggaattgcagctaaaggaaacgatgaaaataatgggtctccctacatggttgcattggactgcatggacctgtaaacagtttgttttcttgttagtatccgcaagtctgacagtgatacttttaaaaataaattggttcacaaacgaagacggcttcagtgagtacacggtgtttactaacacgccttggacagtcttgatgtttttcacgatgctgtacttaacttgcgttatctttttctcatttatgatgagcagctttttctctaaagctagtacagcagcgttgtgcactgtagttgtctggttcctcacatacatccctgccttcctcctggcaatggacatcgaaatgtctacaacagtccaggtctttacatgcctcagtattaattctgcgatgtcttatggattccagcttttgcttgccaaggaaagtactggaggcttgcagtggggcgacttcatgtcggcaccagggacggactctaatcgcttcgtgttcggccacgtggtcatcatgttagtggtggactgcttcgtctacatgctcgtcaccctctacttcgaacaagtgatgcctggaccatttggcacgcccaaacgctggtacttcccgttccagttgcggttttggttcccgcattacaaaccaggtacagttttggttttggaaaatgaaaacagtgaatttgaagacatcataaaggaaaaagaacccaatgaacacgaagtgggcgttaaaatgaataatttaacaaaaatctttggagctaacactgcagtcaacaatttgtctttgaatatttacgacgatcaaatcacagtattacttggacataatggtgctgggaaatcgactacaatatcaatgttgacaggcaatttggaggtaacccggggtactgtgactgtcgcgggatatgacatgacccacgaaacttatgcggctcgtgcccatatcggcttatgtcctcaacacaatgtactgtttaacgaactcacagtcagagaacatttggaattctttgccaggttgaaaggttttcggggagcagagctcaagtctgagattgatactcttattgaaaaattggaactacaagacaagcgagactatccctctaatggtttgtctggaggtcaaaagcgacgtttatgtgttggaatagctttaagtggagcagcacgtgtggtactactcgatgaacctacttcgggaatggatccttcttctcgtagagctctctgggaacttttgcagaaggagaagaaaggtcgatcgatgatcttgaccacgcatttcatggacgaagctgatattctcggtgaccgagtggcaattatggcgcaaggccgcttgcagtgtgtgggttcaccttatttcctgaaacggcattatggcgtcggatacactctggtagtcgttaaggacgatgactttgatttcgaggaatgcactagacttataaataaatacattccagacacggttgttaaagaagaccgcggtacggaaattacttataacttaatcaacgattattcatacgcctttgaagaaatgctgaacgatttggaatgtaatatggaaaagataaaatacaaaaactatggtttaactgctaccactttagaggatgtgtttatgtcagtcggttcggacttggcaccagtaaataattcagataacgatgacgctgttactactacgacggactcgaccattgacgacattttgaaacatgaacttgattcgtctttagaagaattggatagagacgaaagcaatgtgaccggtttccgattgctatgtcagcaagtattagcagtgtggatgaagaaggggctgacactgattcgctcaccttggttgatgatcttgcagttcttcgctcccgtcatactcatcaatgccacgcttggagtcatgagatacgtgatgtccttaaccccaactataagatcaagatttttatcattgactgaaggattcacgagtacagaaaccttgttaagtttcaacggtacattaggatcatctgtcggcgctatcgcggcagcagcatacgagatgatgttcacggcctcagacgtggaaaacatgggcgtgactcgcattgggaacgtacccatggacgagtattatctaaataggaccatggatccagtggtgatggggcagttacgtcaccagatcctgattggctccactttcgacgataacaatgcgacactttggttcagtaacttcggttaccacgacgtcgctatagctctatctaccttccactcggcttttcttagagcattcaactccactgcgcagcttaacgtttacaatcatccattggaggctacttatagagaccagacggacatgcagatgatgattgccatgctctctatgcagctgtcttctggtattggtagcagcgtcagtatcgtcagtgctgtattcatcatgttctttatcaaggagcgcacatctggcgctaagctgttacagaaggccgcgggagtacaaccagcagtgctgtggggtagtgctgctgtcttcaattgggcttggttcctgatcacctgtgtttccatagtaatcacgtgtgccgctttccaagttattggactgtccactgctcaagaattagctcgaatgtacttgtgcgtgatgctgtacggtgctgcgatgttgccgctggtgtacatcctgtcgtttgcgttcaatggacctgccgttggcttcgtcggttattactttatgaacgtgctttttggtatgatgggtgcacaaatagtggaagcactgtcttctcctcagctgaacacagcggaagccgcgaatatactcgactacatattacagttcttcccgctttacagtttaatcactgcagtcagatttttgaaccaagttgggctgcgtgaatacacttgtctacaaatgtgcgagtactatcaagctgtgtcgcctaaccttcagtgcaccatggaaagcttatgttcacgcaacgaagaatgctgtgtcgagccgaatgtttatttcaaatggaatcagcccggcgtatcgcgatacttgacaagtatgattatatcctgcatcgtgttctggacgattcttatgatcatcgagtacagagtcttccagaagttatgtacgatcaagaagaccccaccacctctagacgagagtatactggacgaggacgtgcaaaaagaggcgcagcgcgcgcgcaacgtgctgccctcgcaacgctacgagcatgcgctgatcgccaacgatctctccaagtactacggaaaacatcttgccgtaaatcaaatctcatttggcgttaacgacggtgaatgtttcggtctgttgggtgtaaacggtgccggtaagactaccaccttcaagatgttaatgggtgacgagtctatctcaagcggtgaagcgtttgttagtggacactctgtcgagaaaagtcttggcaaagtacaccagaatatcggttactgtccccagttcgatgctttgtttggtgagctcacgggccgtgagacgctacatatgtttgctatgatgaagggtctgcgtttacgcagtgctgcaccaaccgctgaaacattagcacatgcactcggtttcctcaaacatcttgacaaaagggtaaatcaatattcaggaggaacgaaaagaaagctaaacacggcgatagcattcttgggacgaacgcgtcttgtgttcgtggatgagcccaccactggagtagatcctgccgctaagcgacatgtatggcgagcaacgcgtggggtacagcgcgctggccgcggcgtagtgctgacgtcacacagcatggaggagtgcgaagctctttgctcacggctcactatcatggtcaacggacggttccagtgtttcggcacaccgcaacatcttaagaacaaattttctgaaggatttcacgttaattattaa

SEQ ID NO: 159 - DNA, 4908 bp, Spodoptera frugiperda; identical to SEQ ID NO: 158

SEQ ID NO: 160 - DNA, 3918 bp, Spodoptera frugiperda
atgggatttaggaaaaagaaatctgaatcaagaccagaaaatgaactggacatatcattcataggcatttttcgatatgggaccttccttgagaacacggcgacattcctgggcattttcataagcatgataagtggcggaggcatagcatacaacttgatacaagttggtgagctgagcactgcatttgtggaacgcaccagttttcaagaccagcctagcagtaacatgccacttctgtcgatcttcggtggtgggaaaagactgaacaatgcaagtcacgaggagaatatggaggctctgttacaagatgctacggctatgctgattggtgcgtttgtgtcagtgggtatatcactgctgtgctgcaccgtctccgtcgctttgatcagctggagtgcactgagacagatcacgacaatacgaatgcggtttctggaggcagtactccgacaggacatggcctggttcgacacggacaacgagttcaacttggcttcgaaaatgtctgaaaatttgatgaaactgaaggaaggcatgagcgagaaattagcggttgtcggtaacttgttgggcacgtcggtgatcagcatcgcagtagccattccactgggctgggagctggcactggcctgcatcactgtcatgccattctctgtagcggcctccgtctacctaaccaattatcaaacgaaatcgtcagcacgtgaattggagtcttacagtcaagcagggaagcatgctgaagagatacttaaatcgataaagacagtagtggccttcggtggggaagagaaagaagttaggaaataccgcactttactggagccagcagagaagtatggacgcaaacggggtatctacacgggggtcggcaacgggttcaactgggtgctcacgtactgcctcaacgccatcggtctcgtgtacggcatcaggttggtgttggaggatcgagacaaatctgaagaagaacgcagatatgtcgtcggtgttgtctttagcgtgctgttcaacgtttatatggcgacacaatcgatcactctgtgcgtaccacacttcgaagtgtttgctgcggcccgaggcgctgctgccaccgtgtactacctgttggaaagagaaccagccatagacagtctcagcacacagggtctgtcacctcgtcgagtggtcgggaatatatctttcgaagatattcacttcaattacccttcaagacctgacgttaaggtcctaaaaggtttctcactccacatcaaggcaggagaatgtgtagcactagttgggtcctcaggctgtggaaagtcaaccatattacagctgttgcaacgactgtacgatccccagtctgggtctgtcaagcttgatggaaaagaattaagaaatctgaacttaggatggctgcgatcatctttaggtgtggtaggtcaagaacctgtactgtttcacgggacgatattcgagaacatcgctatcgcttgtccagaagcaactttaccagaagtacaaagagtagcagccatggcctacgcacatgagtttattacaaacttaccgaagggttatgacacagtgataggagagcgcggtgcttctctatcgggcggtcagaagcagcgcatcgccatagctcggtctctgctgcgggagccagctgtgctgctgctggatgaggccacctccgcactcgaccctcactctgaacgtaaggttcaggctgcattggaccgtgccagcgctggaaggaccactattatggtctcgcacaggttgtcgacgatactgaatgcgaaccgtataatatgcatggatcaaggcgttatagtggaacagggaacacacgaagaactcatgaagagtaaaggtttctactacaagttggtgacaacgaataaacagaaaggagagccagaggaagccactgaatctttgccggagttattggaagaagataacgagtccgctgttaatagccctgtggtgcgaagcgaaactaagaagaatagaccaagaatgagcaaacagaattcagtaatagaatctttcgaatggatgcaaactcctcgaggatcagtcacatcagccgtgtctctgggttaccaaagtttcctgcacaatcaagatatcgacaaagataacagtgatgatgaggaaattgtacctttgagcagttgggatattttaaaactcaatgctccagagtgggtttacattacgattggatccgtcgcagcgttcctacaaggagcatgcttcccagcatttgcgttgctgttcggttttactagcggcatctttgtactgacgaatcgcgatgaactgatatccttgggtgacatgtatgcaggccttttcgttgtggtagcagccattgctggtgtgtctatgtgtctccagagctctacatacaccactgctggtttgaaaatgactaccagacttcgagagttgtatttcaacgctttacttagtcaggaaattggatactatgatagagaagcgaatacagttggagcactttgtgcgaggcttagtggagacgcagcggaggtgcagggggctactggtttgaggatcggactcatcttgcagggcgtcagctctgtggttctaggagtcttgatgggattgagtttcgattggcaactgactctcgttgccactgcattcttacctattatgataggcagtatctggctagaaggcatgatgtcacgcaaatctcaggaagacgagagagatgctatggagtctgcgactggagtagccacagaagcaatagttagcatcaaaactgtgcaaagtttaggcatagaaccagtatttctggacaagttccaggagtcgttgacggcagcttgcagagcggtggcacagaagtcaaggtggcggggtgtggttctgggcattggtatctacgctccattgattgccttctgctgtgcaatcatgtacggcgcctatctcgtttccaaagggcaattggaatacaaaatagtgcttttagtaacagaaagtgttatgttcggagcgtacatgcttggtcaaacactggtgtacgcaccaagtttccacgccgctaaggtttccgcagccaggattataggattgatccagagacagcccctggtcagaacagaagatggtgtcactgacaaaaaagattggagtgctaccggtaacttcagtttaaaagaagtcgaatttagctaccctacaagaaaacatcataaggtactcaaaggaattgatttacacgtggatgctggcaaaaccgtggcgctagtgggtccctctggctgtggcaagtcgactgtactacaactgttgcagagattctacgaccctgactctggaagaatagaattagatggacttgacaatcgctcgtcgctcacgctgccccggctacgtcgtcagctgggcgtagtgcagcaagagcccgtactcttcgaccgcacgctcgctgaaaacatcgcttacggagacaacacgaggaaggtcaccatgcacgagatcatcgaagccgcgaaagctgcaaatattcacaccttcatcagttccctgcccaagggttacgacacaaacctagggtctggtggagcgcagctgtctggcggacagaagcagcgagtgtgcattgcgcgcgcgctcatccgggcgccgcgactcttgcttcttgatgaagccacttctgcgctagacgcgaatagtgaacgggtagtatcagaagcactagaaaaagcagctgaaggtcgaacgtgtgtaacgatcgctcaccgtctcactaccatcaaagacgcagatataatctgtgtcctggataaaggtaaaattgtggagcgtggtaatcatgcagatttattgaagctaaaaggccactactggcgaatgtgcagagggcaggaagctccataa

SEQ ID NO: 161 - DNA, 4551 bp, Spodoptera frugiperda
atgtcttacaattccacgcttgatagcttctgtggatctgaattttggaatagcaatctcacatggtataccgacagcccagagctaacgccatgcttccaaaaaacagtgctggtatggacgccgtgtttgtacttatgggtcgcggcgttccttgacacctactacatactgaacagtaaagaaagaaatataccatggaatatactgaacatcagcaaacttttcataacttgccttctgatagtgttaaaatttgtggatctgggcgtaacagtgcacacctcatcccaagaggacatggcagtatttagtgcagattattatagtcccattattaaaattttaacatttggtttatcagctacattattgtactacaatcgaaagtatggtatgcgagcatcaggagtgctgttcttcttctggctacttctgattttggctggactgcctcagctgcagtctcagatcaaagcacacgccaatatccccgatgatgaaaatgttaaatataactttgtcagttacatggtctactttccgctgatagttattatgtttatattgaattgtttcgctgatttacctccgaaagattcaccgtacaaatatgaaaagaatcaatgtccggagaacgcttcaggattccctagtcgtctaacattcagttggttcgaccctctcgccttaactgggttccgtagaagcttgacagaggaagatttgtgggctctcaaccctcaggactcttctactgaggtggttccgaagttcgacaaattctgggagaagtctttgaggaaacgagaaatttcaaacgcaacaaaggcatcgtatcgtaagacatcagctagcgtcaactttaagcctgagagtgagaagaagccggcttccatattgccagcgctatgccttgccttcggaggccagttcttgttcggagccatgctgaagctgttcaacgacgtcctcatgtttatatcgccacagttgctcaaacttcttataggattcgtgcaaggtaaagagccgatatggaaaggttacgtttacgcggtagcgctgcttgcctgtgccacggtgcagaccatgctcctggcgcactacttcacgagaatgtacctggtgggcatgcggataaggactgccttgaccagcgccatctacaggaaatcactccgtatgtccaacgcagcaaggaaagagtcgacggtcggagagattgttaaccttatgtcggttgacgctcaaagattcgttgaactgactgcatatttaaacatgatatggtctgcgccgttgcaaattgctcttgccctttacttcttgtgggggatcctaggaccctctgtactcgcgggtttggcggtgatgattatactgataccagtcaatggcctcatcgccaacagagtcaagacacttcaaataagactcatgaaatacaaagatgaaagagtcaaacttatgaacgaagtacttaatggaattaaggtccttaaaatgtatgcttgggaaccgagtttcgaagatcaaatacttaaaataagaaacaaagagatgaatgtattgaaacagaccgcttatcttaactctgctacctcatttatatggtcttgcgcacctttcctggtgaccttcctaaccttcttcacatttctgataactgatcccgagaacaatgtcctgacagctgaaaatatattcgtgtcgatgtctctgttttacacaatgcacttgcccctaggtttactaccactcatcgtggtatcagcgatcgagacatccgtcggtattaagagattgaacaaattcatgaactgcgacgaactagacattacatccgtggaacacgatcctaaagacccgaacccaatctctattgagaatggtcacttcacgtggggagaccaggattcggagccgtctctcaagaacatcaacctgcacgtaccacgaggctcaatggtcgccatcgtgggcgctgtcggctctggaaagagttctctgctctctgcattgttgggtgaaatgaacaagatttctggacgagttaacacgaccggtagcatagcgtacgtgccgcaacaagcgtggatccaaaacgcaacgctccaggacaacatactgttcggcaaacccctcgacaaacaaaagtacaacaatgtcatcgacatgtgtgctctcaaacctgacttcgaagtcctgcccggcggagaccaaactgaaatcggagagaaaggtataaacctgtctggcgggcagaagcagcgcgtgtccctagcgcgcgcggtgtactgcgacgcggacaactacttcctcgacgacccgctcagcgccgtcgactcgcacgtcggcaagcacatcttcgacaaggtactgggtcccaatgggctgctgaagaacaagacgcgggtgtgggtgacccacaacgtgtcgtacctggcgcagacggacctagtcgtagtgctgcgcgatggagaggtctcggaggccggctcctaccaacaactgctcgagaagaagggcgccttcgccgaattcctgctacatcatctgagcgacgctgagaggacttcaccagaagaattggacgagatcaaacaagacctagagagtaaacttggaaccgagttccagaacaagttacagagagctcgttctctttccgagagtgcatctgaatccgaacaggcggcaggagaccgcgcaggcagcgtgaagagaaagactccagaagcgactccaaacgaattgaaagagaagaataaacttattgaggctgagaaagcggaaactggcagtgtgaaatggggcgtgtacaagcattacctgatgagtgtcggagtgttgtcgtctgtgatcactgtactcatgaatctcattctacaagtattccaagttggatccaactactggctcactgaatgggccaatgatgataaaatgctggtgaacggcacggtagacacgaagcgacgcgacatgtacctcggcgtgtacggcgggctcggtattggacaagtggtgtcggtgtcggtgtcgtcgctggcgctgtacctgggcacgctggcggcggcgcgcgcgctgcacgcggcgctgctggccggcgtgctgcgcgcgccttccatcggcttcttcgactgcacgcccgtcggccgcgtgctcaaccggttcagcaaggacgtcgacgtcctcgacaacgtgctgcccatgacgctcaggggctggacttcctgcttctttgcggttttgggtacgctgttcgtgattagtttctcgacgccgatattcatggctgtgatactgcccatcggattcatctactacgtgatccagagattctatgtggctacgtcacgacaactgaaacgactcgagtccgtatctcgatctcccatctactctcacttcggtgagagcataaccggcgctagcactattcgagcctacggcgtctccgagaggtttgttgaagagtcggagcgcggtgtagatcacaaccagtcctgctactacccaagctgcatcgcaaacagatggctggcagtcaggctcgagatgattggcaatctcatcatattcttctctgcgatgtttgctgtgctcaacagagacacgattagtgctggtctggtgggactttctgttagctacgcgttacagattacacaaactttgaattggctcgttcgcatgacatcagaagttgaaaccaacattgtggccgtggaaaggataaaggaatacgccgaaacagaacaggaagcggcgtggacagtggcgaacggtccgcccgcggagtggccggcgacgggcgcgctgcagctggagcggctgacgctggcgtaccgcgccggcgccgagcccgcgctgcgcgacgtcacgtgcgccgtggcgccgcgcgacaagctcggcatcgtgggccgcaccggcgccggcaagtccacgctcacgctggggctcttccgcatcgtcgaggccgtgggggggcgcatcctcatcgacggcctggacatcgccgccatggggctgcaccagctccgctcgcgcatcaccatcatcccgcaggaccccgtgctcttctccggcacgctgcgcatgaacctcgaccccttcgagaccttctcggacgaggacatctggcgcgcgctggagtacgcgcatctcaagcccttcgtgcaggggctcccggcggggctgcgccacgaggtgtcggagggcggcgagaacctgtcggtgggccagcgccagttggtgtgcctggcgcgcgccctgctgcgcaagactccgctgctggtcctggacgaggccacggccgccgtggacctggagacggacgagctcatccagaagacgatccgctccgagttcgcgtcgtgcacggtgctcaccatcgcgcatcgcctcaacaccatcatggactccaccaaggtcatggtcctcgacaaaggacaactcgtcgaatatgcaccacctgaacaactgctacaagataagaactctatattctatagcatggccaaggatgctggcctagttaattaa

SEQ ID NO: 162 - DNA, 4041 bp, Spodoptera frugiperda
atgatggacaaatctaataaaaataccgcgtcaaatggcacggctgtgggcgaaccaaaggagagagtaagaaagaaaccaaatatattgtcacgtatattcgtttggtggatattccctgtgctcattactggcaacaagcgtgatgtagaagaagacgatttaattgttccgagtaaaaaattcaattctgaaagacaaggagaatattttgaaagatattggttcgaggaggtagcaattgctgagagagaagaccgagatccttcgttatggaaagcgatgcgccgcgcttactggctgcaatacatgccgggagctatcttcgtgctgctcatttctggattaaggacagctcagccattgctgttctctcagctcctgtcctactggtcggtggacagcgagatgtcgcagcaggatgctggtctctatgccctggctatgctggggatcaacttcatcaccatgatgtgcacacaccacaacaacttgttcgtcatgcggttcagtatgaaagtcaagatcgccgcctcgtcactcttatttagaaagttgctccgcatgagtcaagtgtcagtgggcgacgtcgccggtggaaagttagtgaacttgctgtccaacgatgtcgcaaggtttgactacgcgttcatgttcctgcactatctgtgggtggtgccgctgcaagtcggagtcgtcctgtacttcgtgtacgatgctgctggatgggcgccatatgtcggtctttttggagtgattatattaatcatgccacttcaagctggtctaactaaactcacgggtgtggtgaggcggatgacagctaagagaactgacaaaagaattaagcttatgagtgaaattatcaacggtatacaggtcatcaaaatgtacgcttgggagaaacccttccagctagtggtgaaggcggctcgtgcgtatgaaatgagtgctcttaggaagtctatcttcatcaggagcatgttccttgggttcatgttattcactgagcgaagtgtcatgtttctgactgtgctgactctagcgctgactggaaacatgattagtgccactctgatttatcccatccaacagtacttcggtattatcacaatgaacgttaccctcatcttaccgatggcgtttgcgagtttctctgagatgttgatatccttggaacgtattcagggattccttcttttggacgagcgttcagacattcaaattacaccaaaagtggtgaatggtgctggaagtaaactgttcaacaattccaagaaggagggaggcctcgagactggcattgtgctgccaacaaaatactcacctaccgaagcgaatattgccagacccatgcaggatgagcctaacatggctgactatccggtgcaacttaacaaagttaatgcaacatgggcggacctcaatgataacaaagaaatgacactcaagaacatatctttacgtgttcgcaaaaacaaactatgcgctgttattggaccagtgggatcaggaaagacctctcttcttcagctccttttgagagagttgccagtgactagcggcaatctcagcatatctggtaccgtatcctacgctagtcaggagccttggctgttccctgcgactgtgcgggagaacattctgtttggtttggaatataatgtcgccaaatataaagaggtttgtaaagtctgctcattactgccagactttaagcagttcccgtacggtgacttgtctctggttggggagcgaggtgtgtcactgtctggtggtcagagggccaggatcaatttagccagagctgtctaccgcgaggctgatatttacttgcttgacgatcctctatcggctgtagacgcaaacgtcggcaggcaactattcgacggctgcatcaaaggatacctcagcggcaagacatgcatcctggtcacccaccaaattcactaccttaaagctgcagactttattgtagtcctaaacgagggttccgtcgaaaatatgggctcgtacgatgaactaatgaaaactggaacggaattctcgatgctgctctctgaccaagctagtgaaggctctgacactgacaaaaaagaacggccagcaatgatgcgaggaatatcaaagatgtcagtcaagagtgacgatgaggaaggtgaggagaaggttcaagtattggaagccgaagagagacagtcgggcagtctgaagtgggatgtgcttgggaggtacatgaagtcagtcaactcctggtgcatggtggtaatggcattcctcgtgttggtgatcacgcagggtgctgccaccactaccgactactggcttagtttctggactaaccaggtggatggatacatacaaactctacccgaaggagaaagtccaaatcctgaattgaacactcaagttggtctgttaaccacgggacagtacctcattgtgcacggcagtgtagtactagccattataatattgacgcaagtcagaatactttccttcgtagtgatgactatgcgagcttcggaaaatcttcataacaccatttacgagaaattgatagtggctgtaatgagatttttcgataccaatccatcgggtcgtgtcttgaacagattctcaaaagatatgggtgcaatggatgagctgttgccgcgaagcatgttggagactgttcagatgtacctgtctctagccagtgtccttgtgctgaacgcgatagccttaccatggacgttgatacccaccacagtgttgatgtttatatttgtattcctattgaagtggtacattaacgctgctcaagctgtgaaacgattggaaggaactacaaagagtccagtgtttggaatgatcaactctactatatctggactctccaccataagaagctccaactctcaggaccgacttctaaactcatttgatgatgcacagaatctccatactagcgctttctacacgtttttgggtggttcaaccgcatttggtctgtacctggacaccctctgtttaatctacctcggaattatcatgtccatcttcattcttggtgatttcggtgagctgataccggttggtagcgtcggtctggccgtcagtcagtccatggtgctcaccatgatgttgcaaatggccgccaagttcactgccgacttcttgggacagatgacagccgtcgagagggtcctggagtacaccaagctacctaccgaagaaaacatggagactggaccgacaacgccaccaaagggctggccaagtgctggagaggtgacgttctcaaacgtgtacctcaagtattctcctgacgacccaccagtactgaaggacttgaactttgcaatcaagagtggatggaaggtcggagtagttggtagaactggtgctggcaagtcctcgttgatatcagctctgttccggctcagcgacattacaggcagcatcaaaattgatggcctggatactcaaggaattgccaagaagcttttgagatcaaaaatatcaataattccgcaagagccagtgttattctctgcctcgctgcgttacaatctggacccattcgacaactacaacgatgatgatatttggagagcattggaacaggtggaactaaaggagagcataccagccctcgattacaaagtgtcggaaggcggcaccaacttctcaatgggacaacgtcagctggtgtgcctggcgcgcgccatcctccgctcaaataaaattctcatcatggacgaagctaccgctaacgtcgatcctcagacggatgctttgatccagaaaacaattcgtaaacaatttgcaacgtgcaccgtgctcacgatcgcgcatcggctgaataccattatggattcagatcgggtactagtcatggaccagggagtggccgcggagttcgaccacccctacatcttgctgtccaaccccaacagcaagttctcctcaatggtgaaggaaacaggcgacaacatgtcccggatcttgttcgaagtagccaaaacaaaatatgaaagtgattccaaaaccgcttaa

SEQ ID NO: 163 - DNA, 4110 bp, Spodoptera frugiperda
atggagtccaaagtagtattaacggagaagaatcctcatgagaaagccaacgtgatctccaaattatttttaacgtggagtttcagtctctttaaaaaaggctacaagcaaggtctgtcgatcagcgatttgtggcaagcaaggagcggagatgcatcgggacgcctcggtgaccgtctcgaggaggcgtggaagatagaacaagaggaggcgaagaagaaaggcgctaagccttctttctcgaaagctattgttaggaccttctggttcgagtacatgatgattggtcttgtagtcggtgtacttttcatggtagtctggccactaattcctttcactctagcattattcatagaatacttctcaaaagagaagacaccagaatcctaccggcaagctcatatatacaacttcttgatgaacttattcagtacgctgtcagctctcatgctgaaccacaccaatttggctcaaggtcgaatcgggatgaggatacgaatagcttgttgttccttgatatacagaaagattttgaaactgaaccgcgctggattgaacaatactgaggctgggcaagtaatcaacttgatgtcgaatgacgtcaatcggttcgacttggtgacattattcctgaacttcatctggatcactcctattgtggtgccggtggtctgttacctcgtgtggcagcatgttggtattgcaaccctcgctgcactggcggtcgtgggcgtccaaactgttattgtgcaagtatatttgagccatctccaaggaaaacttcgcggtaaaatagcaaaacgaacggatcaacgagtgaaggtgatgagtgagctggtcgatggagttcaggtcattaaaatgtatgcttgggaggagcctttcgagaaactagtccacaaactgcgaaaaatggaagtcggctacgtcctgaggacatccttcgtcaaaggtttcaccaccgccctagccgtgttcaccgagcgattcattctcttctccgctgtcgccacattcgtcctcattggaggaaacatcagagctcaaattaccttctctttagtccagtactttaaccttatgcagatgatttgcaacatctttttgcctatgggacttgcgtacttggctgagactaaagtatccatcaaacgattggaggaattcttgctactcgaagaaaatgaaccagaaaaaattacagccaacatgattctcgattccaaatccttattatctgacggaacagagaaggagaagaaggttcaggagaaacaaagagtgactggtctgaccatttccaacgtgtctgcgagttggaccaacgattccgtagtggatacactaaggaatatcacaataaatgccgcacctggagaattcgttggtgttgcaggtggagttggttctggcaagtcttcgcttttgcaactgattcttggggagttgatgcctaaaagtggcactgtcaatttgggtggagctaaagtatcgtatgccagccaggagccctggctcttcgtggctactgtcagggagaacattctctttggcctgccatacgaccggattaggtacaagaaggtggttagagcttgtgctcttttgagggacttcgaactgctacctcatggagactctaccctggtgggagaaagaggcatcagtcttagtggtgggcaacgagcgagaattggactggcaagagcttgttatagaaaagcggacatctacctccttgacgaccccctatcagccgtggacacccatgtaggcaagcacatggtcaccgaatgtgtcatgggactgctagagaaatccactcgaatcctggtgacgcatcagcttcatcacctcaagggcgcagacaaagtcgttatcctgagacatggtgaagtagaaatccaaggttccttcgacgaagtatctcgcactccactatttgctgaactattacaagacgaggaggaagaagaggctgcaggcgaacacgtcaagatgcagagaagcatttctgtcaggtcacaagctagcagcatctctcctgcagaaggcattatcggtgaagatctgatcgaacaacaagtagaaatagaagaaattacaggcacaggtcgtgtcccaggaaaagtgtattccaaatacttcagcattggagccggttgttgcctcctgtcttccacagtgattgctattctgttcgctcaagtcatcacgtcggtcagcgacttgtggcttactcactggatgaacaacgttgaagctcaatacgtagcaaatgtgcctctgttccgagttgccaacgacaccataattccactaaatgatacactagtgaacgcaacggaatctgcagtgactgaaggaacaataactagtactattggagctatcactacagctttcctatctaatgacacgatggaaacaactgaagctatcctaaacgctactgtatttgatactactattgtggctccagctaaaatcaatgaccgctactacatttatatttgggccgctgctattgtcgggtgtatcattgccacttctggaagagccatgatgttcctgtgggtgtgcatgcgcagttccatcaagctccacaacgagatgttcaggaacattctgagtgccaccatgcggttcttcgacaccaacccctctggtcgtatcctcaacagattctccaaagacatgggcgtcgttgatgaaattctacctagaatgtatttggacactattcaggtgttcatggtgatgatgggtattctcgtgatggttgccatcgtgaacccctacatgttgatgacgactgcagtctgcgctatcgtcatgtacggcttgaccgtcgtctacctcagcacagcacaggctattaaacgagtggaaggtgtgtcccgtagcccagtgttctctcacgtgacggctactatgtctggtctaggcacggtgcgggcgtgtgaagcacaagaaatgctgaaggtacagtttgatgacaagcaggatgtgcacacagctgcatggtacttgacactggtcaccaacacagccttcgccatctggctgagtctttgctgcagcgcttacgttattgtggtcgcgtacaccttcctgttcttagatgacggtaacaccaagtccggtaacgtaggccttgccatcagccagggtctgattctcgtgaacatggtccaatacggagtcaagcaagctacagaggtgatctcacagatgacgtccgtagaaagagtgatgcagttcacatcactaccgcaggagaaaactgaaggacccaagccaccagcgaattggccgcagaaagctcgtgttgtgttcaaagacctcactcttcggtacgataaggacgctgatcccgtactgaagagacttaatgttactattgaaagtggatggaaggttggagtcgttggtcgtactggagctggtaaatcttctctaatctctgctctcttccgtctggcaccgattgaaggcaacgtctacattgacgatgtcgaaaccggcaaaatcgctcttaaagaattgcgttcaaagattgctatcattcctcaagaaccggtgctgttctccgcaagtctgcgatacaacatggatcccttcgacaaatactctgacattcagatttgggaagctttggaacaggtagaattgaagagcagcataacatctctgtcgtctccagtagcatcaggcggctctaacttcagcgcgggacagagacaactgttgtgtttggctcgagctgccctcgcacgcaacaagctcctcgttctagacgaggctactgccaacgttgaccctacaactgacgccatgatccagaagtctattcgcagacatttcgcggattgcaccgtgattacagtcgcacacagattgcatactgttgctgattccgatagagtagtggtaatggaagcaggtcaaatcatagagtgcggtcacccacacgaactactccaagacgaagaaggtcccttcacaaagatggtgaaacaactaggctctgcatccgaacagagtctgcgagaactagctagcaaagcatactccgagcacaacattaagaatgctatgaaagcttaa

SEQ ID NO: 164 - DNA, 4086 bp, Spodoptera frugiperda
atggactcgaaagtggtattgaaagaaaagaacccccacgacaaagcgaacttcatctcgaaaatatttctaacatggagctttagcctatttcgtcgtggatttaagcatggtctcactgtggaggacttgtggcaagcccgagccggcgaccactccggccgcctgggggaccgcctcgaacaagcgtggcaggaggaactcgacaatgccaagagaaaaggcatcaaaccttctttctcaaaggccatcgtacgatcattttggcttgaatatttaatgtgtggcctggttgtaggattactattcatctttttctggccattaattccatacacgttagctttattcataaattatttttccgaagataaaaccccagagagttatagaaatgcacacatttacaacttcctcatgaacttcctgagtatattgacggcattgatgctcaatcatttacaattaagccaaggacgagtaggaatgagagtgagaatagctagctgttcattattgtatagaaaaatattaaaactcgatagaactgggttgaacaaaacggagccaggacaggtgatcaacctgatgtctaacgatgtaaatcgttttgatttagtggctctgtttctgaactacttgtgggtgatgcctatcgtggtgccggtggtctcgtacctggtgtggcagcacgtcggctgggccactctcgctgcactcgtcgtcatattcgtacaaactgtactcgtccaagcctatttaagtaaccgccagggagtattacgaggaaaaattgctaaacggacagatgaaagagtaaaagttatgagtgaactagtaaacggtgtacaagtcatcaaaatgtatgcgtgggagaaaccttttgagaggttggtcgacaaactgcggaagatggaagtgagcttcataatgcgcacatctatgatcaaaggattctcgacggcgctgagcgtgttcacagagcgcttcatcttgttctcggctgtcgttgcgtttgtggtcatgggcggagacatccgcgccgagatcacattctccctcgtccagtatttcaatctactccaactcgcctgcaacatattcttcccactggccctcgcatttctggcagaaactaaagtctcagtgagacgccttgaggagttcttgttgttggacgaactgacacctgcgaagttaccgctagcaatcgattcgaaggaaataattagcaatggtactgagaaggaaaagccgaagcatacgggcttgatattgaatggactgagcgcgagctggcaaccagaggccattgtcaacacgttgaggaacatcacgctgactgcagaacctggagagtttgtgggcattgctggacttgtgggatctggaaagtcgacccttctgcaagtcatcttgggtgagttgcctccaacgcagggcaccatatcgttgggtggcgcgcgagtctcctacgccagccaggaaccttggctcttcgtggcaaccgttcgtcaaaatatactctttggacttccatacgatcgcatacgttacaaaaaggtcgtgagcgcatgcgcactgttgcgggacttcgagcagttgcctgcaggagactcgacactggttggagaacgaggcatcagtctgagtggaggacagcgcgcgcgcatcggactcgccagagcatgttatagacaggccgacatatacctgctggacgatcctctatcagcggtggacacgcacgtcggtaaacacctggtatcagaatgtgtgatgggattactgagacattctacgaggatcctggtcacacatcagctacaccatctcaagtctgctgataaggtcgtcatcctgcacaacggtgaaatagagactactggatcgtttgacgatgtgtcgcggtcgccactgtttgcggagctgctccaggaagaggaacaaccagaagatccgaaagtccagtaccttcgacaaagaactctttctatacagtctcatacaagtaccaacactttacaagatggggctgtggctgatgaggttgagcaggaggagtcggccgagctgatgggaacaggtcgtgtaccaggcgcggtgtatcgtcaatactttcgcgccggcgctggctggggcctcatcttatggacaacgttcagcattcttctggcacaagtcgttacctccatcagtgacctttggctgacacaatggatgaatgtcgtggaaataagacatggattggaaaacaaccaaacgactactcctctcttccataacatcacaaatggcaacaattctattggcagcaatgacaccattagcaatttcactacagagctgccgaccacgataccctcgtccacagaactgcccaacatgactgtcattgatacgatggtgaagactgtcctaactatgcagaatattacgtctgtctacgaaccaatcaaccacgactattatatttatatttgggcgattgctattctaggctgcatcatactcacgactggaagatcgattttgttcctgtgggtgtgcatgcgtagttcgataaagttgcacaaccagatgttcagcaatatactggcggccacaatgcgcttctttgacaccaacccttctggacgaatcctgaacaggttctctaaagacatgggagtggttgatgagatcctaccgaggatgtatttggacagtatacagatattcatggtaatgatgggtattcttgtgatggtagcgatagtcaacccctacatgttgctcacaacgggtgtctgtggtatccttatgtacatttggactgtgattttcctcagcactgcacaggctattaaaagggtggaaggtacgactcgcagtcccgtattctcacatgtttcggcaacgatggcaggactaaatacagtgcgtgcttgtcaagcgcaggacatgttgcgagatcaatttgacgacaagcaagacgtgcacacagctgcctggtacttaacgatcgtcacaaacactgcattctctatttggttaagtcttatctgtgcgacttatgtagtagtcgtagcctacacattcttgctcctggatgacgggactacaaaatcaggaaacgtcggattagcgattagtcaaggcttgatcctagtcaatatggtgcagtatggtgtgaaacaagcgacagaggtgatctcacagatgacaagcgtggagcgtgtagtgcagttcacatcgctaccacgtgaggtgacggacggccctgcaccacccaccggctggccccagcgcgcaaggctggtcttcaaggatctctcgttacgatatgacaaagatgccgatccagtgcttaaaaaacttaacattgttattgaaagcggatggaaagtgggagtagtcggtcgtacgggagctggcaaatcttcactgatatcagctctcttccgcttggcgcctattgaaggaaatgttttcattgatgatgttgataccggcaacatcgctctgaaggagctaagatcaaagatctcaatcattccgcaagaaccagtactcttctccgctagtttgcgttacaatatggatccattcgacaaatattctgacgctgatatttggacagcattagaacaggtggaattaaagcgaagtgtaacgtccttgtcatcagccgttcagtcaggcggttctaacttcagcgctggtcagagacaactgctctgcttggcgcgtgcggctctaggtcgtaacaagctacttgtgctcgacgaagctacagctaatgttgatccgaatacggatgcacttattcaaaaatcaattcgcacacatttcgcggattgcactgtgatcacggtggcacatcgactgcacactgtcgctgactccgacagagtcgttgtaatggaagctggtgagatagtggaatgtggtcatccacatgaactgctacaaaagcccgagggtcacttcactcgcatggtgcagcagttgggccctgctgcggaacagagtctgcgcgacttggcggcagccgcgcatgccgagcacatcaaatacgtcgacaccgacgataacaaccaataa

SEQ ID NO: 165 - DNA, 2064 bp, Spodoptera frugiperda
atgaccgccggcaacgaggagcatgagcctctgattacatcgtccgttgataaccagcgtgttgcttttaataactcgcctactggtggtcctactccagaatcgacgcctcgcggcagtggcggtgaaataaccttggcaataccagcgcaccgtaactatggagccattggagggatcgagaaggtcacttacacgtgggcggacatcaacgccttcgccacagagtccaggtcgagatccaggaggatctggaacttctggaagccgtccgccagtggaatgttccagcagaggaaacagctgttgagaaatgtcaatggcgcggcatacccaggcgagctccttgccatcatggggtcatcaggtgccggtaaaacgacactcctcaacacgctcaccttccgtactccaagcggggtgctgtccagcggtaccagagctctgaatggccagccagctactcctgaggcgttggcagcactgtcggcttacgttcagcaacaggacctgtttattggtacactcactgtcaaggagcatttgatattccaagctatggtgagaatggaccgacacataccatacgctcaacgcatgcgtcgtgtacaagaagtaatctctgagttggcgttaacaaaatgccagaatacggtgatcggtatccctggaaggttgaagggtatatcgggaggtgagatgaagaggctgtccttcgccagtgaggtcctcactgatcctccccttatgttctgtgacgaaccgacttcgggactcgactcgttcatggcgcagaatgtgttacaggtactcaaaggcctagcccagaagggtaagacagtggtatgcaccatccaccagccgtcttcagagctatacgccatgtttgacaagctgctgatcatggctgacggcaaggtcgctttcctcggctctccggaccaggctaacgatttcttcaaagaactaggagcagcctgtccaccgaactacaacccggcagaccacttcatccaactcctggctggagtaccaggcagagaggaaaccacccgtacgaccattgatactgtctgcacagcattcgcgcgatcagaggttggctgcaagatcgctgctgaagctgaaaatgctctatattttgaacgtaaaatctcgtccggctgggcagacccggcgtggtcggaagccacagcgatccgcgcgcgccggtccccgtacaaggcgtcgtggtgcgcgcagttccgcgccgtgctgtggcgctcctggctctccgtcaccaaggaacccatgctcatcaaagtgcgcttcctacagactattatggtatccattctgatcggcgttatctacttcgggcaacacttggaccaggacggcgtgatgaacatcaacggcgccatcttcatgttcctcaccaacatgaccttccagaacatcttcgctgttatcaacgtattctgttcagagctaccaatatttatacgggagcatcattcagggatgtatagagccgacgtgtacttcttgtctaagacgttagctgaagctcccgtgtttgcgaccataccactagtgttcactaccatagcgtattacatgatcggactgaatcccgaaccgaagcggttcttcatcgcttcgggattggctgccctcatcaccaatgttgctacttcgtttggttacctgatatcatgtgccagcaacagcgtcagcatggcggcgtccgtgggacctcccatcatcatccccttcatgctgttcggaggattcttcttgaacaccggctccgtaccaccatacctgggctggatatcgtacctgtcgtggttccactacggcaacgaggctctgctggtgaaccagtggtcgggcgtggagaccatcgcctgcacccgggagaacttcacctgccctgcttctggacaagtcgtcttggatactcttagtttctctgaggacgacttcacaatggacgtgatcaacatggttctcctgttcatagggttccggttcctcgcctacctggcgctgctgtaccgggcgcgccgggccaagtaa

SEQ ID NO: 166 - DNA, 4017 bp, Helicoverpa zea
atgggcgtagaaaataagaataatgtacaaaatgcggaaggtccggcccgcaagacttacaaaaaaccgaacattttatcccgtatatttctctggtggatgtgtcctgtgcttataactggtaacaaaagaaatgtagaagaatcagatcttataccgcccagtaatttatataattcagaaagacaaggagagtatcttgaaagatactggttggcagagatagaaaatgcaacaattgaaaatcgggagccatcactatggaaggcattacgaaaggcctactgggtctcctacatgccaggagctatttttatcatcattcaatctgcagccaggacgtatcagccgctgttgttttctcagttactgtcgtactggtcggtggacagtgaaatgactcagcaagacgctggcctctatgctctcgccatgctgggactgaacttcgtctccatgatgtgtcagcaccacaacacactgtttgtgatgcggttcagtttaaaagtcaaggttgcctgttcttcgcttttgtataggaagttgctccgcatgacccaagtgtcggtgggtgaggtggcaggaggaaagctggtgaacttgctgtccaacgatatcacgaggttcgactacgcgttcatgttcctacattacttgtggatcgtgcctatccaagtggctgttgttttgtatttcttgtgggaggctgctggcttcgcacccttcgtcggtctgtttggagtcgttatactgattttaccactgcaagctggcttgacgaaactcacaactgttgtaagacgtgagacggctaagagaacggacaggcgaattaaactaatgagtgaaattattggtggtattcaggtcattaaaatgtacgcttgggagaaacccttccagctagttgtgaaggcagctcgtgcctttgaaatgagtgccctcaggaagtccatcttcatcaggagtactttcctagggttcatgttgttcactgagcgaagcatcatgtttgtcacagtgttgacactcgctctcacaggcactatgattactgccactacgatataccctattcaacagtacttcagtattattcagtttaacgtaacactgatcattcctatggcaatcgcaagttattccgagatgatggtgtccatagaacgtatccagggattccttagtttggacgagcggtccgacatgcaagtgactccaaaaattaatggatctaacaataacactttgtttaaatccaagaagtcaccacttgaagtaggcatcgtgcctaagaaatactcacctagtgaagttatggctgcaaaggagatgcaggatgatcctacccagatggactatcctatcaggcttaacaaagtaagcgcatcgtggaccggcagcaatagttcttcagaaatgacacttaagaatatatcgttacgtattcgtaaaggaaaattgtgtgctatcattggtcctgtggggtccggaaagacatctctactgcaactgctcttaaaagaattaccattgaatagtggtacacttgacgtgagcgggaaaatgtcgtacgcttgtcaagagtcctggctgttcccaggcacagtacgagaaaacattttgttcggcctaacttacgaacccacaaaatacaaagaggtttgcaaggtgtgttcgttgctgcctgacttcaagcagttcccgtatggtgacctgtctttagtgggagaacgaggagtgtccctgtcaggtggtcaaagagccaggatcaatttggctagagcaatttatcgtgaggccgacatttacttgctggatgatcccctatctgcagtggacgctaatgtaggcagacaactgtttgatggctgcatcaaaggctacctcactggacgaacttgcgtcttggtcacccatcagatccattacctcaaagctgctgattttattgtagtccttaatgagggttccgtcgagaatatgggcacttatgatgagctggtgaagacaggaactgaattctcgatgctgctatccaaccaagaaaatgacgcaactgaaaacgaaaagaaagaccgaccagcaatgatgcgaggaatatcaaaaatctcagttaagagcgacaccgaaatggaacagaaggctcaaatacaggaggcagaggagagagcgacaggtagcttgaagtttgaggtggtgctcaagtacctgagctccgtccagtcctggtgtctggtgtttacggcgttccttgtactgctgatcacgcaaggtgctgccaccactgccgactattggttgagtttctggactaaccaagtggattcttatgaacaatctttacctgaaggcgtggatccagatactgacatgaacgcacaaattggcttacttacaactgcccagtacctatacgttttcggtggagttatattggctttaatagtcatgacccttgtcagaatcacagctttcgtagcgatgacaatgcgagcttctcaaaatcttcacaacactatttacgaaaaattaattgtgacagtaatgagatttttcgataccaatccttctggtcgtgtgctgaacagattctcaaaagacatgggtgccatggatgagcttcttcctcgcagtcttttagaaacagttcagatgtatttgtcgctgaccagtgtgttggtgctgaacgccactgcattgccctggacgcttatacctacctccgtgttgattgtcatcttcgtgctcatgttgagatggtacctgaatacagctcaggctgtcaaacgtttggagggcacaaccaagagtcctgtatttggaatgattaactccactatttctggactctccactattagaagttcgggttcccaggatagacagatgaaattgtttgacgaagcgcagaatctccacacaagtgctttccacacattcttcggcggttctacggcatttgcattgtatctcgatactttgtgtttgacctacctcggtgtcgtcatgtcaattttcattttgggcgactttggtgatttgatcccggtgggaagtgtcggtctggctgtcagtcagtccatggtgctgaccatgatgttgcagatggcagctaggttcacagctgactttttggggcaaatgacggctgtggagagagttctggaatacaccaagctacccacggagaccaatatggagcaaggaccaactaacccaccaaaggaatggcccagtgctggtagagtgacgttctcaaatgtgtacctgaattattccatggaagacccgccggtgctgaaggacttaaactttgaaattcaaagcggctggaaggttggagttgtaggcagaacaggagccggcaagtcatcgctcatcgcggctttgttccggcttagtgacataagcggcagcatcaaaattgacggtgtggacaccgaaggattagccaaaaagactttgagatcgaaaatatcaattattccacaagagccggtgctgttctcggctactctgcgatacaatttggacccgttcgacgattacagcgacgacgatatttggagggcgttggaacaggtggaattaaaagaaggaataccggctttagactttaaggtcgctgaaggtggtactaacttctctatgggacaacgtcagttggtttgcttggctcgtgccattctacgctctaacaaaatactcatcatggacgaagctaccgctaacgtcgatcctcagacggacgctttgatccaaaagacgatccgtcgtcagtttgcgtcgtgcacggtgctcaccatcgcgcatcgactgaacaccatcatggactccgaccgagtgctggtcatggaccagggcgaagtggccgagttcgaccatccccacatcttgctcagcaaccccaatagcaagttcttctctatggtccgagagacaggagaaagcatgacaaggaccttaatggaggtcgctaaggccaaatatgatagtgataataaggaagcttaa

SEQ ID NO: 167 - DNA, 4110 bp, Helicoverpa zea
  misc_feature (1167)..(1167): n is a, c, g, or t
atgggtacaaagaaagacgctaagaacgggacgggcgagaaaataccaccgcccccgccaccgccaaaacaaaaggatgtgccaaacacgtttttgaggacgttattttgctggatgctacctatattttattttggcaatcgaagggacttggagcagcatgatctgccaccaccaaaaaatatgtataattctaaagtggtaggagatagactggagagaaattggctaaatgaagaaagagaggcaaaaagcgaaggacggaagccaaagttcgtgagagttctagtaaggacatttttctggtctttcataccaggtggtttgatgcaatttacttcaatagctttaagaacggcgtctccattgctgttcagccagttacttcagtactggtcagtagactcgacgatggctcgagagacagccatgtactatgccctgggaatgatcctcgccaactggttgtcgtctttcatgaaccaccacggagcactgtactgccagcagttcggtatgaagataaggtgtgctgttggctctttaatgtttagaaagataatgcgtatgagcaacggttccctgggtgagacgacagcgggtaaagttgtgaacttgctgtcaaacgacctgcagagattcgacttggcgatgatgttccttcactatgtgtggatcatacctctgcaagtggccgcggtcatatacctcgggtacttgcaggtggggaccgctgccttcatcggcattgcggctttaatcctcattgttctgcctttccagggtggtatgggtcagtacttaggtaaacttcgacttcgtacagctgaaaaaacggacaacagaataaaaattatgagtgaagttattaatggaatacaggtgataaaaatgtatggatgggagattcctttccaaaatgtggtggggcagaagcgtgcagatgagttgaaagaggtgaaaagagctaccattgtgaggacagtgttcctcgggttcatgatgttcacggagagaactgcgctcttcctaactgtgctcacatacgtcttgcttggaaacgtcatgtcggcgaatgtcttctacccgctgcagcagttcatgaacgcggctcaagtgaacgttacattaatcttgccgctggtattgtctttcactgcagagctnttggtctctctgggaagggttgagaaatttctggcgttgcaggacaggcccgacttgacggggcagtcggaggaggtctcgtccaacttgttccgcaacatgtcggcgaaagataacttggacaacttggagatgaatggctccgtacgaccactctcgtaccatcgcaaatcggatggagcgcctatagggcctaccttaggggcagagctcaaaaagtctcctaacccgaagttcgcgaggagtgtgtcatatcaggacgacactgctttggtagtacacgatgtgtccgctagttggacaggggaccccaatgctttggccctcaagaacatttctatgagactgcgtaaaggaaaactttgtggtatcatcggcgctgttggctctggaaagtcctcgattctgcaacttctactaaaagaattgccctcggcgactggcagtgtttcaatatacggcaagatctcgtacgcttgccaagaggcgtggctgttccccagcaccgttcgggagaatatacttttcggtttgccttatgaacccgaaaaatataagaaggtatgccgcgtgtgtgcgctggagaaggacttcaagcagttcccgtacagcgaccagacgctggtcggggagaggggggtgtcgctctcaggaggccagcgagccagaatcaatttggcgcgcgctgtttacagagaagcagacatctatctattggacgatccgctgtccgctgtggacgcgaacgtgggtcgtcagctgttcgaaggctgcatcaacggctacctgcgcgggcgcacacggatacttgtcactcatcagatacacttcctcaaagctgccgactatatcgttgttttaaatgagggtcgtattgaaaacatgggaacatttgaagaactggtaaattctggcaaggaattctctatgatgctctcacaactgcaggaaggcaaggagaaggactctgacagtttaggatcacggagcattgaagagaaagataggcctgcactgaagaccatggccagcgtgacagaagaagatgacggggaggagtttgaagctcagaagatggaagaagaagagaggcagtcaggcaacctgcggtgggaggtgatcgccgcgtactttaaagctggagggaacgcctgtttcatattgtttgctctgtccatgatcgtgctgtctacgaccagcgcagcttctgttgactactgggtcagttattggacgaatcagatggctgtgtacgaggagtccttgggcggtgctgatatagatcccggcttggatgtgcaagtaggcatattcacgatagcccagtacttaataatccatggtgcacttgtggcgatgtgcatcgccataataaacctgcgagtgtttcccttcgcctacctctgcgtcaacgcgtccagtaacctgcataacaccatgttctccaccatgctgaaggggatcatgcgtttctttgacaccagctcatcaggtcgtatattgaatcggtttacaaaagacatgggtgctctcgacgaaatcttgccacggacactgttggacgtgcttcaaatctacggaaccctgactgctattctcgtcctgaacgccatagctctgtactggaccctgttaccctcagctgtgcttcttattttgttcatctttatggtccggatttatttgaaggcagcgcagggtataaaacgattggaaggaacagccaaaagtccaatgtttggtacagtgacgtcatcgctcagtggcatatctaccatcagatcagcaaatgcccagaagtggcttattgaacagtttgatacgaatcaggacttgcacaccacttcatggaacagctacttgaatggaggcaccacattcgggttctacttagacaccatgtgtttgatatacatgaccactgtcataggcgtcttcctgtttgttgatttcggcgacacgatccccgtgggcagtgtaggtctagcggtgacacagagcaatatgttgacgatcatgctgcagcacggagcgcgcatgttagtggagttcctcgcgcagctgaccagcgtcgagcgcattctgcagtacacacgcattgacacagaacctaacttgttccaaggaaaaatcgaaatgccctcatcatggccttctcaaggaaaaattgtctttcaaaatgtgtatctacgatatgcgccaaatgaacaacccgtattgaagaacctgaaccttgtcatagaaagtggacataaggtcggaatagtaggacgcacgggagctggcaaatcttccctgatatcagctctgttcagatttgcctacatcgacggattaatatcgattgacggactcgatacttcgctggtttcgcgccagggactgcgatcaaaaatttcaattataccgcaagaaccaatcctgttctctgctacaatccgatataacttggatccgtttgacatgtacagcgatgatgacctctggagagctctcgaacaggttgacctaaaatcggctatcccatcattagactttaacgtaaccgaaggtgggtctaatttctcagtgggccagcgacagttgatgtgcttggcgcgtgctgtactacgatccaatcagattttaataatggacgaagctaccgcgaacgtagatcctcagacggacagcttcatccaggaaacgatccgtcggcagttcgtgtcatgcaccgtgctgacgatcgctcatagactcaacactatcatggactcggacaaggtgctggtggtgagcagcggcgagatcgcggagtacgaccacccgtacgtgctgctgtccgaccccgacagccacttctccgccatggtgcgcgagaccggcgagaagaacagtgccaacttattccgaattgccaaagactgttattttcaaagcaatctgaaagaaaacgcaagataa

SEQ ID NO: 168 - protein, 1333 aa, Diatraea saccharalis
MAKQEENFFHKDRKKPNILSRIFFCWICPVLVKGNRRDVVEDDLIVPSKIYNSKQQGDKLEKSWSAEVQLAQRENRNPSLWAALRRAYWLEYMTGAIYILTITAVRIVQPMLFAQLLSYWTVDSEMTSFDAGVYALALLGLNFVTMMCQHHNSLFVMSFSLKIKVACSAVLYRKLLRLNQVSVGEVAGGKLVNLLSNDVARFDFAFMFMHYLWIIPIQVAIVLYFLYGVGGYAPFVGLFGVMILILPIQAGLTKLTASVRRNVAIRTDKRIKLMNEIINGIQVIKMYAWEKPFQLVVKAVRAHEMSALKKAIFIRSVFLGFMLFTERSIMFFTVLMLALSGNMISATTVYPIQQFLSTILINLTMILPLAIATLSEMKVSLERIQGFLELDEREALSHKNGISNGALNRSLFSSKQGAIESDITAKKYVSTDVVETLQSEINKSAKPSEFAVDVCSVTASWKDVASEEATLKNIAMRVRHGKLCAIIGPVGSGKTSLLQLLLKELLPHAGSLAINGKVSFSCQESWLFPGTVRENILFGSTFDSQKYKEVTRVCCLVPDFNQFPYGDQSLVGERGVTLSGGQRARINLARAVYRDADIYLLDDPLSAVDANVGRLLFEGCIRGYLRKKTCLLVTHQIHYLNDSDWIVILKDGTIENMGTYDDLVKSGKDFSLLLKELQDSDDTGKEENLEKRPSMQRGMSVKSEENPEDQKEQVLEAEERAKGNLKWTVVAQYLKLVKSYPLLFLAVLTLLITQAAATFVDYWLSALTNAVDAYVQTVPEDQTPDPSLGTSLGSLTTGQYLWIHGGVILGIIVFSQLRILTFVITTMRASQNIHDKIFNNLIQAVKRFFDTSPSGRALNRFSKDLGAVDELLPRSLLETLQMYLAMTSVLVLNAIALPWTLIPTTFLVVLFVFLLRWYLQAAQAVKRLEGTTKSPVFGMINSTISGLSTIRSSNSEYRLQNQFDKAQNLHSSAFYTFLGGSSAFGLYLDVLCLVYLGLVMATFILFDFGGTIAVGSAGLAVSQSMVLTMLLQMAARFTADFLAQMTSVERTLEYAKLPKEQYIDEGPTKPPPIWPATGHITFENVYMKYGPEDPYVLKNLNIEIRSGWKVGVVGRTGAGKSSLISALFRLTNIEGAIKIDGIDTYGIAKSVLRSKISIIPQEPVLFSSTVRYNLDPFNKYSDDDLWRALEQVELKEAIPALDYKVTEGGSNFSMGQRQLLCLARAVLRSNKILIMDEATANVDPQTDALIQKTIRREFAACTVITIAHRLITIMDSDRVLVMNKGEAVEFDWPYVVLSKPDSHFNFLVKETNDSMSKVLHDIAKTKYFQENPQ

SEQ ID NO: 169 - protein, 1367 aa, Diatraea saccharalis
MNSKKQAHGQKPTQEKNKSKDSPLQKDVPGILSRFFFCWMMPLYYNGIKRDLEEFDLVPAKHQYDSKVVGDLLERKWLEEEVKAKAEGRTPSLRNVLIKTYWVSFIPGGIMQFLYVSIRTVTPLLFAQLLQYWSVNSTMSRETAVVYAVSMIAANWVAAFFNHHGNLYCQQFGMMLRVATSSLMYRKLMRMNNASLGDTAVGKVVNILSNDMQRFDMAMLFLHYVWIIPIQMAAVCYLGYLQAGPAALVGLAALIVIALPIQGYLGQLIGKLRLRIAEKTDERIKVMTEVISGIQVIKMYAWELPFQNVVSEKRGAEMKQVRIALLYRTVFLGFMMFTERAALFITVLVFILFGNTMTANIIYPLQQFMNAAHINITLVLPLVLAFTAELLVSIKRIQDFLILEDRPDLVKSSHTSSPGKLFQKSSSVFEKIEGPIRPLSFQTHSEFSDNVGKQQMPPVNRMMLRSLSQPGGDTAVELRNVTARWTSDPNLCALKNISVRIRRGKLFAIIGAVGSGKSSILQLLLKELPAANGTVSIYGNLSYASQEPWLFPSTVRENILFGLPYDAEKYKRVCRTCCLEKDFKQFPYGDQTLVGERGVSLSGGQRARINLARSVYREADIYLLDDPLSAVDANVGRLLFEGCINGYLRGSTRILVTHQIHFLKAADYIIVMNEGQIENMGTFEELTQLGKEFSTMLASLQEGKDKDGDSIGSGGSMESKEKKRPARTISVNNEVEEFEEFEAQKMQAEERASGNLRWDVVVAYFRSGGSICFILFTLFMILLASAASAATDYWVSYWSNSMAAYEESLEGATPEPGLDVQVGMFTTGQYLIIHGSLVLACILITNLRVFPFVGLCIGASKKLHNFMFSTMLKGIMRFFDTSSSGRILNRFTKDMGALDEILPRTLLDVLQINGVLLGILILNAIALYWTLIPSAVMLLLFFFMVRIYLKMAQSVKRLEGTTKSPVFGIVTSSLNGIATIRSAGAEQRLINDFDNHQDLHTAAWNGYLCGGGSFGLYLDTMCLVYLTTVIFVFLYLDFGDIIAVGSVGLAVTQSNMLTAMLQHGARMLVEFIAQLTSVERILDYTRIDTEENLFEGKIASIPTWPSNGAIIFDNVSMRYSPDEPPVLKNLNIVIQSGWKVGIVGRTGAGKSSLISALFRFAYIDGTITIGNIDTALVARQELRSKISIIPQEPVLFSATIRYNLDPFNIYSDADIWRALEQVDMKGAVPSLDFKVTEGGANFSVGQRQLLCLARAVLRSNKLLIMDEATANVDPQTDSFIQQTIRTHFASCTVLTIAHRLNTIMDSDRVLVMGAGQVLEFDHPFILLSDANGHLTSMVKETGEKNANQLLEVAREAYFQSNMKENAR

SEQ ID NO: 170 - protein, 1731 aa, Diabrotica virgifera virgifera
MYATAARVSTRKIRTLLRSSKERIMGEKLDKFLLLMWKNWLLQYRKPIQTIIEIVAPVLFSFLLVYIRSLSDPTYEHERIYKPFCAFEGNFNLSLPLFCNDPDAVQAGPSLFSNMQAGDSNFSLTILYTAPEDKYYDDVIGFFKLIPKVNTQRVISSGELERISLAGNSSYYGIEFGGDRDNVEVNIRFPGETVYQLDSIGRQNWRTNLVYPVFQSSGPRSPDNATGSAPNYFAEGFLAVQHFVTTALLLADKGITHDDPQGMFNFLMDASNPFPLIQMQRFPFASWFSDQLLTALTSMLGMIVMLSFVYTCINTVKSITTEKEKQLKESMKIMGLPNWLHWLAWFVKCFIFVIISVALMVVLLKVRWYSNTEFTVFTYADPFVLFVFLLLYCCSMITFCFALSVFFSKANTAATMAGLAWFISYAPYLFMQNNYTDLALSTKLLTSLLPNTAMAFGFQVVLMYEGTGDGVTWSTLFKPNTPDDTLSLGLIWIMIIINTIIYLLIALYIEAVFPGEYGVAEKWYFPFTKKYWCGKGAVSDYNNYNDHSANEFFETEPNLRPGIQIFNLKKAFGKKTAVRNLSLNMFENQITVLLGHNGAGKTTTMSMLTGMISPTNGTAKINGHDIRLDIAGVRNSLGLCPQHNIIFDELTVEEHLYFFSKLKGLSKSKITAEIDKYVKLLDLEPKRKEKSSTLSGGMKRKLCVGMALCGNSKVVMLDEPTAGMDPSARRVLWELLQKQKEGRTILLSTHFMDEADLLGDRIAIMAGGELQCCGSSFFLKKKYGAGYSLIMDKAKTCNPHKVTELLKKFIPEIEIHSNVGSELTYLLSENNAPVFEAMLKQIEQESNELGIRSYGISLTTMEEVFMKVGADHGQEEIYNEKQKKDKKEKNPILTSADLGPESLSPSYTGGLHLIVNQFVAMLMKKIIGTFRSWVLLAIQIFLPMINVIIVMSVPSGSVPSVLPAMPLNLARFTDPITLIERFDDPQNYTNNFYGVLNGYGMSPTNIDNITRIMLDLTATNPNVVRRSYIIGSTFTEQEFEFGIIKTIHPVITAWFNNDPYHSPGIALGMALSSVYNHYTNGHIEFVNKPLPFKAATQIDNIVGGQSQGFQFAFNIGFSMAFISSFYVIFLIRENVSKSKHLQFVSGVKVYIFWFVNIICDMFVYLLVCSVLLITIYCFQQDGFKTSGDMGRLFFLLLLFGWSFMPIYYVASLIFTVPSTGYTRMTLVGIFIGNAAFLLVEVLKTQSTNLKRIGETLDNVFLVFPHYSLATGINKCYAIYSYNTLCETVFDSCAQNNFTKDECISKFPSTVADICTNLNDNYFSWNNNGIAKNVTYSLISGVLWSILLFIIEYKFIARLMYYINQKFFPKQPILIQDEDDDVSKEKERIHMATDHDIRQTNILVVKDLTKYYNNFLAVNGLSIGIEKSECFGLLGINGAGKTTTFKMMSGDETVSYGDAWIEGKSVKTQLKQVQRNIGYCPQFDALLDDMTARETIIMYCLLRGIEFKRTQRIANFLSRDFDFHRHLDKKVKEMSGGNKRKLSTVLSLIGDPPVLFLDEPTTGMDPATKRYLWDSLCKIRDNGKCIVLTSHSMEECEALCTRIAIMVNGNFKCLGSTQHLKNKFAEGYTLTIKLKKLPESGGLVHADTESLEKYIKDKFPYAHLREKHQELLYYYITDTSMAWSTMFGILERAKRSDLNIEDYSLGQSSLEQVFLTFTKHQNPEGDDVKKKN

SEQ ID NO: 171 - protein, 1554 aa, Diabrotica virgifera virgifera
MANLTELTTLPTTVTELPKLTSNSSQQNATIEEEAYAALSSFCGSPFWDTNLTWNTNDPEFTPCFEKTVLVWIPCIFLWVFAGLEVFYIFNSKRRNIPWNWLNLSKLAITATLIVLTISDIVNSFKTAGNRGSEVNDVDIYSPLIKILTFALTGVFIFYNRKHGLQTSGLLFLFWFFVVLCAIPQFRTEIRRSQRNEILPDYYYFYTSYLIYFPLVVLMFLLNCFADKAPLERKYPQSQNPSPEESASFLSRLLFAWFDPLAWKGFRKPLETKDLWDINVEDSSRELVPVFEKYWSQTLKKAESTSPTQVAHAKFKSDSASVDFVNNKKKKQASILPALFKCFGPIYFFGALLKLIQDLLTFVSPQILGFLISYTRFNQEMWKGYLYAVLLFITATIQTLFLAQYFNRMFVVGMRIRTVLVSTIYRKALKISNSARKESTVGEIVNLMAVDAQKFMDLIGYLNMIWSAPLQICLSLYFLWKELGPSVLAGLAVMIILIPVNGFIANKIKKLQVKQMKNKDERVKLMNEILNGIKVLKLYAWEHSFEDQVLKIRNKEIKVLKQAAYLNAGTSFIWSCAPFLVSLVTFATYVLVDEKHVLDANKAYVSISLFNIIRFPLSMLPMMLSNLVQTWVSVKRINKFMNAEELDPDNVLHEPSEEPLTIENGTFSWGEGPILKDININIKKKTLTAIVGTVGSGKSSLISAFLGEMDKLSGRVNSYGKVAYVSQQAWIQNATLRDNILFGKPYDKTLYDAVVEACALNPDLEMLPAGDQTEIGEKGINLSGGQKQRVSVARAVYSNADIYFLDDPLSAVDSHVGKHIFEKVIGPHGLLKSKTKILVTHGITYLPQTEKIIVLKDGRISETGTYQELLDRKGAFAEFLLQHITEEAETEAELDELKDQLADTPLSQEVARQLVRHRSRVSESQSETGSDHIGNGSIQRLNSVDKSNHKLSIDDGKKGPKKGEKLIETEKAETGNVSWAVYKHYLKSIGLVFMLATLIFNLVYQGFSVGSNVWLGLWSDDQKIVVNDTVDTARRDMYLGVYGALGLGQAIPAIFTDVSLQLGCFAAAVIMHKKLLSGVLRSPMAFFDTVPIGRILARFSKDVETVDHDLPWFFSDTCFCVFEVVGTLAVISYSTPVFILVIIPLCFIYYFMQRFYVATSRQVKRLESVSRSPIYSHFGESVSGAHAIRAYNQQERFIVESENKVDMNQICYYPGIISNRWLAVRLEMIGNLIIFFAALFAVLKKDQAPGLVGLSVTYSLQITQTLNWLVRMTSDVETNIVAVERIKEYGEAPQEAAWEIPSKQTSPAWPEEGTVQFKNYSVRYRPGLDLVLHDLDFEIKGGEKVGIVGRTGAGKSSLTLALFRIIEAAQGNILIDGIRIDELGLHTLRSRLTIIPQDAVLFSGTLRINLDPFNKHSDEDVWRSLEHAHLKEFVKGLPAGLNHEVTEGGENLSVGQRQLICLARALLRKTKILILDEATAAVDLETDDLIQKTIRTEFKECTVLTIAHRLNTIMDSDRVIVLDKGRIAEFDSPARLLANENSIFASMSRDAGLA

SEQ ID NO: 172 - protein, 1742 aa, Helicoverpa zea
MRLETRHASAATKFRLLMWKNFLQQWRHRLQTVVELLLPVVTMALVLILRWQIPPYQIDTLTYPALPAHTLNYSTNILFAMNMEELSIAYSPASPVLDDVMRTAVINLLTANMKDLIPIFIDNLPPGIANITFPPDMNLNTSAIEEFVKSRIRVVPYNSSYEIRGIYVDEETTRSIIAAVEFDDKLYGAEQLSNNLSYSLRFPERPRLNSFFQTGGRTWRSDGVFPVFEVPGPRFPHSWEGGNDPGYVNEMFVALQQVISMELVSRATGLDLKSFRVNIQRYPHPPYLHDQSVDLLQFMFPLFIMLSFSYTAVNIARAVTVEKELQLKETMKIMGLPTWLHWTAWFVKQFIYLSITAVLLVVLLKVNWFTNDDGFSEYAVFTNTPWTVLLFFLILYLSCAIFFSFMVSSIFSKGSTAALFMAVAWFLTYIPAFLLAMDINMSTAVQVITCFSINSAMSYGFQLMLAKESTGGLQWGDFMTSPGTDTTRFVFGHVVIMLVVDCLIYMLITLYLEQVLPGPFGTPKPWYFPFQLQFWFPNYKSKDAGLIFENDNSEFDDIIKEKDPTDHEVGVKMQNLTKIFGNNIAVNNLSLNIYDDQITVLLGHNGAGKSTTISMLTGNLKVTRGTVNVAGYDMTSQSSAARSHIGLCPQHNILFNELTVKEHLEFFARLKGFKGKELYEEIDSLIEKLELQEKRDYPSKGLSGGQKRRLCVGIALSGAARVVLLDEPTSGMDPSSRRALWELLQKEKKGRSMILTTHFMDEADILGDRVAIMANGRLQCVGSPYFLKRHYGVGYTLVIVKDTDFDFVKCSVLINSYIPGTIVKEDRGTEITYNLVNDYSHVFEEMLNDLERNIDNIKFKNYGLVATTLEDVFMSVGADLSPINSESDDAITTTTDSTIDDILKQEIDSSLEELDKDESNVTGLRLFGQQVLAVWMKQWLVLIRSPWVMVLQFLAPVVLINSTLGVLRYVMSLSPTIRTRWLSLEEGYTESETLLSFNGSVASSVGALAAQAYQSLFANSGVMDMEINAIGSQPIEEYYLNRTSDPVVMGSLRHRLLIGSTFDDNSATAWFSNFGYHDVATSLAAIHSAILRSKNSDAVLNVYNHPLEASYIDQSDVQTMIAMLSMQLSSGIGSSVSIVSAVFIMFYIKERMSGAKLLQNAAGVAPSVLWGGAAIFNWFWFLITCVSIVISCVAFDVIGLSNVHELGRMFLCVMVYGAAMLPLVYLLSLKFKGPAVGFVGFYFLNVLFGMMGAQVVEALSSPMLDTEQAAHILDYLLQFYPLYSLVTSIRFLNQVGLREYTCLQGCEYLQAVYPNLECSMASMCEFHSNCCVRENPYFDWEEPGVLRYLLSMCFSCLIFWLLLMTIEYRVVQKVFTFKKTPPPIDESTLDEDVMTEARRARQVPPTRRSDHALLAHDLSKYYGKHLAVDQVSFSVNDGECFGLLGVNGAGKTTTFKMLMGDESISSGEAYVSGHSVQRNLDRVHENIGYCPQFDALFGELTGRQTLHMFALMRGLRLRTAAPSAETLAHALGFFKHLDKRVHQYSGGTKRKLNTAIAFMGRTRLVFVDEPTTGVDPAAKRHVWRATRGVQRAGRGVVLTSHSMEECEALCSRLTIMVNGRFQCLGTPQHLKNKFSQGFTLIIKMKTDDSDSDTQSVNSTTSVVDSVKLYVSGNFESPKIMEEYHGLLTYYLPDRSMAWSRMFGIMERAKQILQIEDYSISQTTLEQIFLQFTKYQREEGTTL

SEQ ID NO: 173 - protein, 1266 aa, Helicoverpa zea
MKDSDGNGRQLKPGDKENGNKLPDPLNGEFPKGKDSDTSSEADSKADEVPSIAFITLFRFATKKDKIFIVCALICSVVAACSTPINTLLLAFLLDAMVEYGSSIRDGTPDPDTFLEALMFFAIYNTVTGVVLIILSYAATVLMNIAAYHQVHVIRQEYLKAALNQDFAYYDIHKNADIASKINSDVVKLEDGIGEKLATFVFYQAAFFSSVIMALVKGWKLALLCLISFPVTLTLVGVAGLVGARFGKKEAIASGKAGAIAEEVISAIRTVYAFSGQSKEMVRYEGHLREARKINIKKGFFNGLAMGLLFFCIFCAYALSFWFGYRLLSTDDDYDISTMIAVFFGVMTGSANFGISSTLMEVFGSARGAGAQIFNMIDNIPTINPLLNRGTTPPNIQGNIELKNVIFHYPSRPDVPVLKGINISVKRGQSVALVGHSGCGKSTIIQLISRFYDVIDGSVAIDGHDVRDLSVRWLRDQIGLVGQEPVLFNTTVRENIRYGRENCTNEEIEACARQANAHQFIMRLPKGYDTLVGERGASLSGGQKQRIAIARALVRNPKILLLDEATSALDTSSEARVQKALDKAQKGRTTLVVAHRLSTIRNVDVIYVFKSGVVVERGNHDELMSQKGHYYDMVMLQNLGAEDTNDKSRLMRETSETSVEDEEDEEEFLDFKTGDTEDDVDNVPDISFWRVLRLNKPEWKSVSLASICSLMSGFSMPLFAVIFGDFLAILSDPDPAVVLNEVRKIALIFVGIGVFSGITNFIVVFFYGIAGEYLTERLRQMMFKKLLEQEVGFYDDKDNSTGALCARLSGEAATVQGATGQRIGTVVQAVGTFGFALVLSLVYEWRVGLVALTFVPVIVFVLYKQGRMTYKASFGTAKTMEKSSKIAVEAVANVRTVASLGREDTFRREYEKQLNPALQEAIKASHYRGLVFGLSRGIFNFVIAASLYYGGTLIVSEDIPYDVVFKSAQALLMGSSSAAQAFAFAPNFQKGIKAAGRIIMLLNRQSKITDPVRPAVHNFKGTGEASLQGIKFCYPTRPMIQVLKGLQLEIQRGKTLALVGASGCGKSTVIQLLERYYDPDEGIVAQDGVPLPKLRLVDSRRAIGFVQQEPILFDRTIGENIAYGNNEQKVTQDEIIQAAKQANIHNFISSLPLGYDTNIGAKGTQLSGGQKQRVAIARALIRRPKMLLLDEATSALDTESEKVVQEALDAAKAGRTCVMIAHRLSTVRDADVICVIHDGLVAETGTHTELIERKGLYYNLNRRGYA

SEQ ID NO: 174 - protein, 1261 aa, Pseudoplusia includens
MKDSENGWKQKPGDGDIRHRIPDLDKGEFAKDKNNDTYSEPEEKDDEVPSISFITLFRFATKMDKCFMFFAIIFSMIAACSTPINTLLLAFLLEAMVEFGKSVIAGAPDTDQFMSDLFWFAIYNTITGALLIVLSYAATTLMNISAYNQVYIIRQEYLKAALNQDFGYFDIHKNGDIASKVNSDVVKLEDGIGEKLATFIFYQASFFSSVIMALIKGWKLALLCLISFPVTMTLVGVAGLVASRLSKKEAVASGKAGAIAEEVISAIRTVYAFSGQGQEIMRYDEHLKDARKINIKKGLFNGLAMGLLFFCIFCAYALSFWFGYQLMQTDDYDVSTMIAVFFGVMTGSANFGISSTLMEVFGVARGAGAQIFHIIDNVPTINPLLNKGTAPASIEGSIELKNVVFHYPSRPDVPVLKGVSISVQRGQSVALVGHSGCGKSTIIQLISRFYDVIDGSVAVDGHDVRNLQVRWLREQIGLVGQEPVLFNTTVRENIRYGREDASNEEIEKCARQANAHHFIMKLPKGYDTLVGERGASLSGGQKQRIAIARALVRNPKILLLDEATSALDTSSEAKVQKALDRAQEGRTTIVVAHRLSTIRNVDVIYVFKGGNVVESGSHDLLMSQKGHYYDMVMLQNLGAEENTESKGLSREQSVRSEKEDEDDFLGNAADPEEDDEAAPDVPFTTVLKLNSPEWKSVTAASVCSLLSGFAMPLLAVIFGDFIGVLSSPDDDEILASVRRYALIFVGIGVFSGITNFIVVFLYGIAGEYLTERLRRQMFEKLLQQEVAFYDDKNNSTGALCARLSGEAAAVQGATGQRIGTVLQALGTFGFALVLSLIYEWRVGLVALTFVPIITFVLYKQGRMTYAESAGTAKTMEASSKIAVEAVANVRTVASLGREDTFRKEYAKQLLPALVMAKRSTHWRGIVFGLSRGIFNFVIASSLYYGGTLIVSEGLDYSVVFKSAQALLMGASSAAQAFAFAPNFQKGIKAAGRVINLLNRQSKITDPAHPAYPAFKGTGEASLQNVQFRYPTRPMVQVLKSLNLEIERGKTLALVGASGCGKSTVIQLLERYYDPEGGIVAQDGVPLTKLRLIDSRRAIGFVQQEPILFDRTIGENIAYGNNEKNVTADEVIDAAKQANIHNFITSLPLGYETNIGSKGTQLSGGQKQRVAIARALIRRPKMLLLDEATSALDTESEKVVQEALDAAKAGRTCVMIAHRLSTVRDADVICVIHDGQVAEMGTHDELIKLKGLYYNLNRRGYA

SEQ ID NO: 175 - protein, 1344 aa, Pseudoplusia includens
MESEIKNPQISINVLPAPETPKKRHKPNIFSTIFIWWMCPVLINGNKRDVEEEDLITPSKAYDSERQGDYFERYWLAEVERAASENREPSLWSAMRRAYWVQYMPSAIYILIITTARTAQPLVFAELLSYWSVDSTMSTYDAGFYALAMLGLNFISLMCQHHNSLFVVRFGMKVKVACSSLLYRKLLRLSQVSVGEVAGGKLVNLLSNDIARFDYAFMFLHYLWIVPIQAAVVLYFLYDVAGYAPFVGLFGVVIFILPLQAALTKLTAVIRRSTAKRTDKRIKLMNEIINGIQVIKMYAWEKPFQLVVKLARAYEMTALKKSIFVRSMFLGFMLFTERSIMFFTILTLALTGTMISATIIYPIQQFFSIIQMNVTLILPLAIASFSEMLVSCERIQSFLILEERSDMQVTPKIIGGKNKLFNSKNGHLEPGDVLPKKYVPSELSVTKPAEEPVQSDYPIVINRVSASWTGSNKPEDVTLKNISMRVRKGKLCAVIGPVGSGKTSLLQLLLRELPLMDGTLNVKGKLSYACQESWLFPGTVRENILFGLPYDVTRYKEVCKAACLVPDFKQFPYGDLSLVGERGVSLSGGQRARINLARAIYREADIYLLDDPLSAVDANVGRQLFDGCIKGYLAGRTCVLVTHQIHYLKTADYIVVLHEGAIENMGSYDELAKSGTEFSNLLSDQAGNSDVTDVKTNRPAMLRGISKISVKSQEEQDEEEKAQVLEAEERGTGSLKFEVIWSYIKAVQSWTIVILALVSLMITQGAATTADYWLSFWTNQVSEYEISLEPGQLPDTSLDAQIGLLTTAQYLIVLGSVIGGIIIISHLRILAFVVMTMRASQNLHNIIYEQLIIAVMRFFDTNPSGRVLNRFSKDMGAMDELLPRSILETIQMYLSLASVLILNAIALPWTLIPTAVLLVVFVFFLRWYISAAQAVKRLEGTTKSPVFGMISSTISGLSTIRSSDSQTRLLRTFDSAQDLHTSAFYTFMGGSTAFGMYLDAMCLAYLGVVLAIFLLGDFSDIIPVGSVGLAVSQSMVLTLMLQMAARFTADFLGQMTAVERVLDYTKLPSEENMETGPTTPPNDWPKVGQVAFNNVYLNYSPDDPPVLKNLNFVIQSGWKVGVVGRTGAGKSSLISALFRLSNITGHITIDGLDTEGIAKKVLRSKISIIPQEPVLFSATLRYNLDPFNNYSDEDIWRALEQVELKDGIQSLEFKVTEGGSNFSMGQRQLICLARAVLRSNKILIMDEATANVDPQTDALIQTTIRREFAACTVLTIAHRLNTIMDSDRVLVMDKGEAVEFDHPHILLSDPNSIFSSMVRETGENMAKVLFDVAKNKYDSDNKTA

SEQ ID NO: 176 - protein, 1367 aa, Pseudoplusia includens
MTEKMGTKKEENTGTKSSPPPQPKTVPNVLSRSFFCWVFPLFYFGNRRDLEEYDLVPPRHIYDSKLVGDQLERVWYEEEKKAKLQGKTPSFTRVLIKTFGWSFLPGGIIQFISIALRTASPLLFSELLKYWSTESDMSRETAMYYAITMILFNWASSYANHHGLLFCQQFGMKLRVATGSLMFRKIMRMSNGSLGETTAGKVVNLLSNDLQRFDLATMFLHYVWIIPIQLAAVVYLGYVQAGTAALIGFASLIVIALPIQGVLGKALGAIRLRTAEKTDERIKLMSEVINGIQVIKMYAWEIPFQKVVGEKRAVEMGEVVKGTRLRTVFIGFMQFTERSALFITVLMFILFGNSMSANVFYPLQQFMNAAQINITLFLPLVITFTAELYVSLGRVQEFLSLQDRPDLSEKTEYIESSNLFRNMSTKRNSTQQVRPLSYQQKSNGFAVDEMVEKPVIPYNRRFSRSVSVQEDCALKLHDVSASWTGDPNMMAIKNVSMRLRKGKLCAIIGPVGSGKSSILQLLLKELPPASGSVSIYGQISYACQEAWLFPSTVRENILFGLPYEPEKYKKVCKVCTLEKDFKQFPYGDQTLVGERGVSLSGGQRARINLARAVYREADIYLLDDPLSAVDANVGRLLFEGCINGYLRKRTRILVTHQIHFLKAADFIVVLNEGRIENMGTFDELVGSGKDFAQMLAGLQEGKDKDAESLGSHASLEDKPRPALKTMASVNEGEDLEEFEEQKKEQEERSSGNLRWEVVLTYFKSGGNLCFVLFTVGVVLLAVASGASVDYWVSYWTNQMAVHDATGGGSTDSDSGPNFDEQVGLFTTGQYLIIHGCLVLSCIFLTNMRVFPFAHLCNTASINLHNNMFSTMLRGVMRFFDTSDSGRILNRFTKDMGALDEILPRTLLDVIQMYGSLVAIFVLNAIALYWTLVPSAVLGTLFFFMVRVYKKAAQGIKRLEGTTKSPMFGVVTSSLNGIATIRSSNSQDRLIEQFDTDQDLHSSAWNCFLSGGATFGFYLDTICLVYLTAVIFVFLFLDFGESVPVGSVGLAVTQSNVLVMLLPHAARVLVEFLAQLTSVERILQYTHIDTEPNLFQGKIDMPPTWPSRGSLIFQNVSMRYAPTEEPVLKNLNIVVESGWKVGIVGRTGAGKSSLISALFRFAHIEGSISIDGIDTSLISRQGLRSKISIIPQEPILFSASIRYNLDPFNSFSDDDLWRALEQVDLKPVIPSLDFKVTEGGSNFSVGQRQLMCLARAVLRSNQILVMDEATANVDPQTDNFIQETIRRRFASCTVLTIAHRLNTIMDSDRVLVMSSGEVAEFDHPYVLLSDPNSHFSSMVRETGEKNSANLLRIAKDAYFQSNLKENAR

SEQ ID NO: 177 - protein, 1635 aa, Spodoptera frugiperda
MRLVPKQASPFAKFRLLMWKNFLQQWRHRTQTVLEILLPVLTMTLVLILRWQIEPAERETQTYPPFRANTLNFSTVVLFGLDCPNVSIAYSPTSPVLEDVVRNAITNLLIQNMEDLIARLPIEIELPPTIEINSTAILDWIKSRIRVQAYNNSHETRGIYIEEENTRRVIAVVEFDDKLYGAESLSNNLSYSLRFPERPRLNSLFQTGGRTWRTDAVFPVFETPGPRFSKSWEGGNDPGYVNEMFIALQQVISTELISRSTGVNMSEFTVFLQRYPHPPYIRDMALDLLQFMFPMFIMLSFSYTAINITRAVTVEKELQLKETMKIMGLPTWLHWTAWTCKQFVFLLVSASLTVILLKINWFTNEDGFSEYTVFTNTPWTVLMFFTMLYLTCVIFFSFMMSSFFSKASTAALCTVVVWFLTYIPAFLLAMDIEMSTTVQVFTCLSINSAMSYGFQLLLAKESTGGLQWGDFMSAPGTDSNRFVFGHVVIMLVVDCFVYMLVTLYFEQVMPGPFGTPKRWYFPFQLRFWFPHYKPGTVLVLENENSEFEDIIKEKEPNEHEVGVKMNNLTKIFGANTAVNNLSLNIYDDQITVLLGHNGAGKSTTISMLTGNLEVTRGTVTVAGYDMTHETYAARAHIGLCPQHNVLFNELTVREHLEFFARLKGFRGAELKSEIDTLIEKLELQDKRDYPSNGLSGGQKRRLCVGIALSGAARVVLLDEPTSGMDPSSRRALWELLQKEKKGRSMILTTHFMDEADILGDRVAIMAQGRLQCVGSPYFLKRHYGVGYTLVVVKDDDFDFEECTRLINKYIPDTVVKEDRGTEITYNLINDYSYAFEEMLNDLECNMEKIKYKNYGLTATTLEDVFMSVGSDLAPVNNSDNDDAVTTTTDSTIDDILKHELDSSLEELDRDESNVTGFRLLCQQVLAVWMKKGLTLIRSPWLMILQFFAPVILINATLGVMRYVMSLTPTIRSRFLSLTEGFTSTETLLSFNGTLGSSVGAIAAAAYEMMFTASDVENMGVTRIGNVPMDEYYLNRTMDPVVMGQLRHQILIGSTFDDNNATLWFSNFGYHDVAIALSTFHSAFLRAFNSTAQLNVYNHPLEATYRDQTDMQMMIAMLSMQLSSGIGSSVSIVSAVFIMFFIKERTSGAKLLQKAAGVQPAVLWGSAAVFNWAWFLITCVSIVITCAAFQVIGLSTAQELARMYLCVMLYGAAMLPLVYILSFAFNGPAVGFVGYYFMNVLFGMMGAQIVEALSSPQLNTAEAANILDYILQFFPLYSLITAVRFLNQVGLREYTCLQMCEYYQAVSPNLQCTMESLCSRNEECCVEPNVYFKWNQPGVSRYLTSMIISCIVFWTILMIIEYRVFQKLCTIKKTPPPLDESILDEDVQKEAQRARNVLPSQRYEHALIANDLSKYYGKHLAVNQISFGVNDGECFGLLGVNGAGKTTTFKMLMGDESISSGEAFVSGHSVEKSLGKVHQNIGYCPQFDALFGELTGRETLHMFAMMKGLRLRSAAPTAETLAHALGFLKHLDKRVNQYSGGTKRKLNTAIAFLGRTRLVFVDEPTTGVDPAAKRHVWRATRGVQRAGRGVVLTSHSMEECEALCSRLTIMVNGRFQCFGTPQHLKNKFSEGFHVNY

SEQ ID NO: 178 - protein, 1261 aa, Spodoptera frugiperda
MKDSKGNAWQLKPGEKENENKLPDPLNEDVQKGQFSDTSSEPSEAKAEEVPSIPFITLFRFASTRDKLFITCALICSAVAAVSTPLNTLLLAYLLEAMVNYSIFGDADAFMKSLLNFAIYNAAVGAALVVLSYAATTLMNIAAYNQVYVIRQEYLKAALNQDFGYFDVHKNAEIANKMNSDIMKLEEGIGEKLATFFFYQASFLSSVIMALVKGWKLALLCLISFPVTMTLVGVAGLIAASLSKKEAIATGKAGAIAEEVISAIRTVYAFSGQEKELDRYEGHLNDARKINVKKSLFNGLAMGCLFFCIFCAYALSFWFGYRLMVTDGYDVSTMIAVFFGVMTGSANFGISSTLMEVFGSARGAGAHIFNMIDNVPTINPLQNRGTVPSDIEGNIELKNVEFHYPSRPDVPVLKGVSIKVKRGQSVALVGHSGCGKSTIIQLISRFYDVVEGSVAIDGNDVRDLSVRWLREQIGLVGQEPVLFNTTVRENIRYGRENATNEEIEACARQANAHQFIMKLPKGYDTLVGERGASLSGGQKQRIAIARALVRNPKILLLDEATSALDTSSEAKVQKALDKAQEGRTTIVVAHRLSTIRNVDVIYVFKAGLVVECGNHTELMASKGHYYDMVMLQNLPGVDEQSPEKTKLSRETSIISEKDDEDEFLEFRNDDKEEDAAEAPDISFMRVLKLNKPEWKSVTLASICSLMSGFCMPLFAVIFGDFLALLDGDDPDEIQKGVSRLALIFVGIGVFSGITNFIVVFFYGIAGEALTKRLRLMMFRKLLEMDIGFYDDKDNSTGALCARLSGEAAAVQGATGQRIGTVVQAVGTFGFALVLSLIFEWRVGLVALTFVPIIIFVLYKEGRMTYAATSGTVKVMETSSKIAVEAVANVRTVASLGREETFRREYSKQLRPALDTAVRSSHWRGLVFGMSRGVFNFVIASSLYYGGTIIVNEGVPFEQVFKSAQALLMGATSAAQAFAFAPNFQKGIKAAGRVIVLLGRQSKITDPAEPAVKHFNGTGEASLQGIQFRYPTRPLVRVLKDLNLEIQRGKTVALVGASGCGKSTVIQLLERYYDPEDGIVAQDGVPLPKLNLVDARRAIGFVQQEPILFDRTIGENIAYGNNEARVSNDEVIEAAQQANIHNFITSLPLGYDTNIGSKGTQLSGGQKQRVAIARALIRRPKMLLLDEATSALDTESEKVVQEALDKAKAGRTCVMIAHRLSTVRDADVICVIHEGQVAEMGTHNELLELKGLYYNLNRRGYA

SEQ ID NO: 179 - protein, 1305 aa, Spodoptera frugiperda
MGFRKKKSESRPENELDISFIGIFRYGTFLENTATFLGIFISMISGGGIAYNLIQVGELSTAFVERTSFQDQPSSNMPLLSIFGGGKRLNNASHEENMEALLQDATAMLIGAFVSVGISLLCCTVSVALISWSALRQITTIRMRFLEAVLRQDMAWFDTDNEFNLASKMSENLMKLKEGMSEKLAVVGNLLGTSVISIAVAIPLGWELALACITVMPFSVAASVYLTNYQTKSSARELESYSQAGKHAEEILKSIKTVVAFGGEEKEVRKYRTLLEPAEKYGRKRGIYTGVGNGFNWVLTYCLNAIGLVYGIRLVLEDRDKSEEERRYVVGVVFSVLFNVYMATQSITLCVPHFEVFAAARGAAATVYYLLEREPAIDSLSTQGLSPRRVVGNISFEDIHFNYPSRPDVKVLKGFSLHIKAGECVALVGSSGCGKSTILQLLQRLYDPQSGSVKLDGKELRNLNLGWLRSSLGVVGQEPVLFHGTIFENIAIACPEATLPEVQRVAAMAYAHEFITNLPKGYDTVIGERGASLSGGQKQRIAIARSLLREPAVLLLDEATSALDPHSERKVQAALDRASAGRTTIMVSHRLSTILNANRIICMDQGVIVEQGTHEELMKSKGFYYKLVTTNKQKGEPEEATESLPELLEEDNESAVNSPVVRSETKKNRPRMSKQNSVIESFEWMQTPRGSVTSAVSLGYQSFLHNQDIDKDNSDDEEIVPLSSWDILKLNAPEWVYITIGSVAAFLQGACFPAFALLFGFTSGIFVLTNRDELISLGDMYAGLFVVVAAIAGVSMCLQSSTYTTAGLKMTTRLRELYFNALLSQEIGYYDREANTVGALCARLSGDAAEVQGATGLRIGLILQGVSSVVLGVLMGLSFDWQLTLVATAFLPIMIGSIWLEGMMSRKSQEDERDAMESATGVATEAIVSIKTVQSLGIEPVFLDKFQESLTAACRAVAQKSRWRGVVLGIGIYAPLIAFCCAIMYGAYLVSKGQLEYKIVLLVTESVMFGAYMLGQTLVYAPSFHAAKVSAARIIGLIQRQPLVRTEDGVTDKKDWSATGNFSLKEVEFSYPTRKHHKVLKGIDLHVDAGKTVALVGPSGCGKSTVLQLLQRFYDPDSGRIELDGLDNRSSLTLPRLRRQLGVVQQEPVLFDRTLAENIAYGDNTRKVTMHEIIEAAKAANIHTFISSLPKGYDTNLGSGGAQLSGGQKQRVCIARALIRAPRLLLLDEATSALDANSERVVSEALEKAAEGRTCVTIAHRLTTIKDADIICVLDKGKIVERGNHADLLKLKGHYWRMCRGQEAP

SEQ ID NO: 180 - protein, 1516 aa, Spodoptera frugiperda
MSYNSTLDSFCGSEFWNSNLTWYTDSPELTPCFQKTVLVWTPCLYLWVAAFLDTYYILNSKERNIPWNILNISKLFITCLLIVLKFVDLGVTVHTSSQEDMAVFSADYYSPIIKILTFGLSATLLYYNRKYGMRASGVLFFFWLLLILAGLPQLQSQIKAHANIPDDENVKYNFVSYMVYFPLIVIMFILNCFADLPPKDSPYKYEKNQCPENASGFPSRLTFSWFDPLALTGFRRSLTEEDLWALNPQDSSTEVVPKFDKFWEKSLRKREISNATKASYRKTSASVNFKPESEKKPASILPALCLAFGGQFLFGAMLKLFNDVLMFISPQLLKLLIGFVQGKEPIWKGYVYAVALLACATVQTMLLAHYFTRMYLVGMRIRTALTSAIYRKSLRMSNAARKESTVGEIVNLMSVDAQRFVELTAYLNMIWSAPLQIALALYFLWGILGPSVLAGLAVMIILIPVNGLIANRVKTLQIRLMKYKDERVKLMNEVLNGIKVLKMYAWEPSFEDQILKIRNKEMNVLKQTAYLNSATSFIWSCAPFLVTFLTFFTFLITDPENNVLTAENIFVSMSLFYTMHLPLGLLPLIVVSAIETSVGIKRLNKFMNCDELDITSVEHDPKDPNPISIENGHFTWGDQDSEPSLKNINLHVPRGSMVAIVGAVGSGKSSLLSALLGEMNKISGRVNTTGSIAYVPQQAWIQNATLQDNILFGKPLDKQKYNNVIDMCALKPDFEVLPGGDQTEIGEKGINLSGGQKQRVSLARAVYCDADNYFLDDPLSAVDSHVGKHIFDKVLGPNGLLKNKTRVWVTHNVSYLAQTDLVVVLRDGEVSEAGSYQQLLEKKGAFAEFLLHHLSDAERTSPEELDEIKQDLESKLGTEFQNKLQRARSLSESASESEQAAGDRAGSVKRKTPEATPNELKEKNKLIEAEKAETGSVKWGVYKHYLMSVGVLSSVITVLMNLILQVFQVGSNYWLTEWANDDKMLVNGTVDTKRRDMYLGVYGGLGIGQVVSVSVSSLALYLGTLAAARALHAALLAGVLRAPSIGFFDCTPVGRVLNRFSKDVDVLDNVLPMTLRGWTSCFFAVLGTLFVISFSTPIFMAVILPIGFIYYVIQRFYVATSRQLKRLESVSRSPIYSHFGESITGASTIRAYGVSERFVEESERGVDHNQSCYYPSCIANRWLAVRLEMIGNLIIFFSAMFAVLNRDTISAGLVGLSVSYALQITQTLNWLVRMTSEVETNIVAVERIKEYAETEQEAAWTVANGPPAEWPATGALQLERLTLAYRAGAEPALRDVTCAVAPRDKLGIVGRTGAGKSTLTLGLFRIVEAVGGRILIDGLDIAAMGLHQLRSRITIIPQDPVLFSGTLRMNLDPFETFSDEDIWRALEYAHLKPFVQGLPAGLRHEVSEGGENLSVGQRQLVCLARALLRKTPLLVLDEATAAVDLETDELIQKTIRSEFASCTVLTIAHRLNTIMDSTKVMVLDKGQLVEYAPPEQLLQDKNSIFYSMAKDAGLVN

SEQ ID NO: 181 - protein, 1346 aa, Spodoptera frugiperda
MMDKSNKNTASNGTAVGEPKERVRKKPNILSRIFVWWIFPVLITGNKRDVEEDDLIVPSKKFNSERQGEYFERYWFEEVAIAEREDRDPSLWKAMRRAYWLQYMPGAIFVLLISGLRTAQPLLFSQLLSYWSVDSEMSQQDAGLYALAMLGINFITMMCTHHNNLFVMRFSMKVKIAASSLLFRKLLRMSQVSVGDVAGGKLVNLLSNDVARFDYAFMFLHYLWVVPLQVGVVLYFVYDAAGWAPYVGLFGVIILIMPLQAGLTKLTGVVRRMTAKRTDKRIKLMSEIINGIQVIKMYAWEKPFQLVVKAARAYEMSALRKSIFIRSMFLGFMLFTERSVMFLTVLTLALTGNMISATLIYPIQQYFGIITMNVTLILPMAFASFSEMLISLERIQGFLLLDERSDIQITPKVVNGAGSKLFNNSKKEGGLETGIVLPTKYSPTEANIARPMQDEPNMADYPVQLNKVNATWADLNDNKEMTLKNISLRVRKNKLCAVIGPVGSGKTSLLQLLLRELPVTSGNLSISGTVSYASQEPWLFPATVRENILFGLEYNVAKYKEVCKVCSLLPDFKQFPYGDLSLVGERGVSLSGGQRARINLARAVYREADIYLLDDPLSAVDANVGRQLFDGCIKGYLSGKTCILVTHQIHYLKAADFIVVLNEGSVENMGSYDELMKTGTEFSMLLSDQASEGSDTDKKERPAMMRGISKMSVKSDDEEGEEKVQVLEAEERQSGSLKWDVLGRYMKSVNSWCMVVMAFLVLVITQGAATTTDYWLSFWTNQVDGYIQTLPEGESPNPELNTQVGLLTTGQYLIVHGSVVLAIIILTQVRILSFVVMTMRASENLHNTIYEKLIVAVMRFFDTNPSGRVLNRFSKDMGAMDELLPRSMLETVQMYLSLASVLVLNAIALPWTLIPTTVLMFIFVFLLKWYINAAQAVKRLEGTTKSPVFGMINSTISGLSTIRSSNSQDRLLNSFDDAQNLHTSAFYTFLGGSTAFGLYLDTLCLIYLGIIMSIFILGDFGELIPVGSVGLAVSQSMVLTMMLQMAAKFTADFLGQMTAVERVLEYTKLPTEENMETGPTTPPKGWPSAGEVTFSNVYLKYSPDDPPVLKDLNFAIKSGWKVGVVGRTGAGKSSLISALFRLSDITGSIKIDGLDTQGIAKKLLRSKISIIPQEPVLFSASLRYNLDPFDNYNDDDIWRALEQVELKESIPALDYKVSEGGTNFSMGQRQLVCLARAILRSNKILIMDEATANVDPQTDALIQKTIRKQFATCTVLTIAHRLNTIMDSDRVLVMDQGVAAEFDHPYILLSNPNSKFSSMVKETGDNMSRILFEVAKTKYESDSKTA

SEQ ID NO: 182 - protein, 1369 aa, Spodoptera frugiperda
MESKVVLTEKNPHEKANVISKLFLTWSFSLFKKGYKQGLSISDLWQARSGDASGRLGDRLEEAWKIEQEEAKKKGAKPSFSKAIVRTFWFEYMMIGLVVGVLFMVVWPLIPFTLALFIEYFSKEKTPESYRQAHIYNFLMNLFSTLSALMLNHTNLAQGRIGMRIRIACCSLIYRKILKLNRAGLNNTEAGQVINLMSNDVNRFDLVTLFLNFIWITPIVVPVVCYLVWQHVGIATLAALAVVGVQTVIVQVYLSHLQGKLRGKIAKRTDQRVKVMSELVDGVQVIKMYAWEEPFEKLVHKLRKMEVGYVLRTSFVKGFTTALAVFTERFILFSAVATFVLIGGNIRAQITFSLVQYFNLMQMICNIFLPMGLAYLAETKVSIKRLEEFLLLEENEPEKITANMILDSKSLLSDGTEKEKKVQEKQRVTGLTISNVSASWTNDSVVDTLRNITINAAPGEFVGVAGGVGSGKSSLLQLILGELMPKSGTVNLGGAKVSYASQEPWLFVATVRENILFGLPYDRIRYKKVVRACALLRDFELLPHGDSTLVGERGISLSGGQRARIGLARACYRKADIYLLDDPLSAVDTHVGKHMVTECVMGLLEKSTRILVTHQLHHLKGADKVVILRHGEVEIQGSFDEVSRTPLFAELLQDEEEEEAAGEHVKMQRSISVRSQASSISPAEGIIGEDLIEQQVEIEEITGTGRVPGKVYSKYFSIGAGCCLLSSTVIAILFAQVITSVSDLWLTHWMNNVEAQYVANVPLFRVANDTIIPLNDTLVNATESAVTEGTITSTIGAITTAFLSNDTMETTEAILNATVFDTTIVAPAKINDRYYIYIWAAAIVGCIIATSGRAMMFLWVCMRSSIKLHNEMFRNILSATMRFFDTNPSGRILNRFSKDMGVVDEILPRMYLDTIQVFMVMMGILVMVAIVNPYMLMTTAVCAIVMYGLTVVYLSTAQAIKRVEGVSRSPVFSHVTATMSGLGTVRACEAQEMLKVQFDDKQDVHTAAWYLTLVTNTAFAIWLSLCCSAYVIVVAYTFLFLDDGNTKSGNVGLAISQGLILVNMVQYGVKQATEVISQMTSVERVMQFTSLPQEKTEGPKPPANWPQKARVVFKDLTLRYDKDADPVLKRLNVTIESGWKVGVVGRTGAGKSSLISALFRLAPIEGNVYIDDVETGKIALKELRSKIAIIPQEPVLFSASLRYNMDPFDKYSDIQIWEALEQVELKSSITSLSSPVASGGSNFSAGQRQLLCLARAALARNKLLVLDEATANVDPTTDAMIQKSIRRHFADCTVITVAHRLHTVADSDRVVVMEAGQIIECGHPHELLQDEEGPFTKMVKQLGSASEQSLRELASKAYSEHNIKNAMKA

SEQ ID NO: 183 - protein, 1361 aa, Spodoptera frugiperda
MDSKVVLKEKNPHDKANFISKIFLTWSFSLFRRGFKHGLTVEDLWQARAGDHSGRLGDRLEQAWQEELDNAKRKGIKPSFSKAIVRSFWLEYLMCGLVVGLLFIFFWPLIPYTLALFINYFSEDKTPESYRNAHIYNFLMNFLSILTALMLNHLQLSQGRVGMRVRIASCSLLYRKILKLDRTGLNKTEPGQVINLMSNDVNRFDLVALFLNYLWVMPIVVPVVSYLVWQHVGWATLAALVVIFVQTVLVQAYLSNRQGVLRGKIAKRTDERVKVMSELVNGVQVIKMYAWEKPFERLVDKLRKMEVSFIMRTSMIKGFSTALSVFTERFILFSAVVAFVVMGGDIRAEITFSLVQYFNLLQLACNIFFPLALAFLAETKVSVRRLEEFLLLDELTPAKLPLAIDSKEIISNGTEKEKPKHTGLILNGLSASWQPEAIVNTLRNITLTAEPGEFVGIAGLVGSGKSTLLQVILGELPPTQGTISLGGARVSYASQEPWLFVATVRQNILFGLPYDRIRYKKVVSACALLRDFEQLPAGDSTLVGERGISLSGGQRARIGLARACYRQADIYLLDDPLSAVDTHVGKHLVSECVMGLLRHSTRILVTHQLHHLKSADKVVILHNGEIETTGSFDDVSRSPLFAELLQEEEQPEDPKVQYLRQRTLSIQSHTSTNTLQDGAVADEVEQEESAELMGTGRVPGAVYRQYFRAGAGWGLILWTTFSILLAQVVTSISDLWLTQWMNVVEIRHGLENNQTTTPLFHNITNGNNSIGSNDTISNFTTELPTTIPSSTELPNMTVIDTMVKTVLTMQNITSVYEPINHDYYIYIWAIAILGCIILTTGRSILFLWVCMRSSIKLHNQMFSNILAATMRFFDTNPSGRILNRFSKDMGVVDEILPRMYLDSIQIFMVMMGILVMVAIVNPYMLLTTGVCGILMYIWTVIFLSTAQAIKRVEGTTRSPVFSHVSATMAGLNTVRACQAQDMLRDQFDDKQDVHTAAWYLTIVTNTAFSIWLSLICATYVVVVAYTFLLLDDGTTKSGNVGLAISQGLILVNMVQYGVKQATEVISQMTSVERVVQFTSLPREVTDGPAPPTGWPQRARLVFKDLSLRYDKDADPVLKKLNIVIESGWKVGVVGRTGAGKSSLISALFRLAPIEGNVFIDDVDTGNIALKELRSKISIIPQEPVLFSASLRYNMDPFDKYSDADIWTALEQVELKRSVTSLSSAVQSGGSNFSAGQRQLLCLARAALGRNKLLVLDEATANVDPNTDALIQKSIRTHFADCTVITVAHRLHTVADSDRVVVMEAGEIVECGHPHELLQKPEGHFTRMVQQLGPAAEQSLRDLAAAAHAEHIKYVDTDDNNQ

SEQ ID NO: 184 - protein, 687 aa, Spodoptera frugiperda
MTAGNEEHEPLITSSVDNQRVAFNNSPTGGPTPESTPRGSGGEITLAIPAHRNYGAIGGIEKVTYTWADINAFATESRSRSRRIWNFWKPSASGMFQQRKQLLRNVNGAAYPGELLAIMGSSGAGKTTLLNTLTFRTPSGVLSSGTRALNGQPATPEALAALSAYVQQQDLFIGTLTVKEHLIFQAMVRMDRHIPYAQRMRRVQEVISELALTKCQNTVIGIPGRLKGISGGEMKRLSFASEVLTDPPLMFCDEPTSGLDSFMAQNVLQVLKGLAQKGKTVVCTIHQPSSELYAMFDKLLIMADGKVAFLGSPDQANDFFKELGAACPPNYNPADHFIQLLAGVPGREETTRTTIDTVCTAFARSEVGCKIAAEAENALYFERKISSGWADPAWSEATAIRARRSPYKASWCAQFRAVLWRSWLSVTKEPMLIKVRFLQTIMVSILIGVIYFGQHLDQDGVMNINGAIFMFLTNMTFQNIFAVINVFCSELPIFIREHHSGMYRADVYFLSKTLAEAPVFATIPLVFTTIAYYMIGLNPEPKRFFIASGLAALITNVATSFGYLISCASNSVSMAASVGPPIIIPFMLFGGFFLNTGSVPPYLGWISYLSWFHYGNEALLVNQWSGVETIACTRENFTCPASGQVVLDTLSFSEDDFTMDVINMVLLFIGFRFLAYLALLYRARRAK

SEQ ID NO: 185 - protein, 1338 aa, Helicoverpa zea
MGVENKNNVQNAEGPARKTYKKPNILSRIFLWWMCPVLITGNKRNVEESDLIPPSNLYNSERQGEYLERYWLAEIENATIENREPSLWKALRKAYWVSYMPGAIFIIIQSAARTYQPLLFSQLLSYWSVDSEMTQQDAGLYALAMLGLNFVSMMCQHHNTLFVMRFSLKVKVACSSLLYRKLLRMTQVSVGEVAGGKLVNLLSNDITRFDYAFMFLHYLWIVPIQVAVVLYFLWEAAGFAPFVGLFGVVILILPLQAGLTKLTTVVRRETAKRTDRRIKLMSEIIGGIQVIKMYAWEKPFQLVVKAARAFEMSALRKSIFIRSTFLGFMLFTERSIMFVTVLTLALTGTMITATTIYPIQQYFSIIQFNVTLIIPMAIASYSEMMVSIERIQGFLSLDERSDMQVTPKINGSNNNTLFKSKKSPLEVGIVPKKYSPSEVMAAKEMQDDPTQMDYPIRLNKVSASWTGSNSSSEMTLKNISLRIRKGKLCAIIGPVGSGKTSLLQLLLKELPLNSGTLDVSGKMSYACQESWLFPGTVRENILFGLTYEPTKYKEVCKVCSLLPDFKQFPYGDLSLVGERGVSLSGGQRARINLARAIYREADIYLLDDPLSAVDANVGRQLFDGCIKGYLTGRTCVLVTHQIHYLKAADFIVVLNEGSVENMGTYDELVKTGTEFSMLLSNQENDATENEKKDRPAMMRGISKISVKSDTEMEQKAQIQEAEERATGSLKFEVVLKYLSSVQSWCLVFTAFLVLLITQGAATTADYWLSFWTNQVDSYEQSLPEGVDPDTDMNAQIGLLTTAQYLYVFGGVILALIVMTLVRITAFVAMTMRASQNLHNTIYEKLIVTVMRFFDTNPSGRVLNRFSKDMGAMDELLPRSLLETVQMYLSLTSVLVLNATALPWTLIPTSVLIVIFVLMLRWYLNTAQAVKRLEGTTKSPVFGMINSTISGLSTIRSSGSQDRQMKLFDEAQNLHTSAFHTFFGGSTAFALYLDTLCLTYLGVVMSIFILGDFGDLIPVGSVGLAVSQSMVLTMMLQMAARFTADFLGQMTAVERVLEYTKLPTETNMEQGPTNPPKEWPSAGRVTFSNVYLNYSMEDPPVLKDLNFEIQSGWKVGVVGRTGAGKSSLIAALFRLSDISGSIKIDGVDTEGLAKKTLRSKISIIPQEPVLFSATLRYNLDPFDDYSDDDIWRALEQVELKEGIPALDFKVAEGGTNFSMGQRQLVCLARAILRSNKILIMDEATANVDPQTDALIQKTIRRQFASCTVLTIAHRLNTIMDSDRVLVMDQGEVAEFDHPHILLSNPNSKFFSMVRETGESMTRTLMEVAKAKYDSDNKEA

SEQ ID NO: 186 - protein, 1369 aa, Helicoverpa zea
MGTKKDAKNGTGEKIPPPPPPPKQKDVPNTFLRTLFCWMLPIFYFGNRRDLEQHDLPPPKNMYNSKVVGDRLERNWLNEEREAKSEGRKPKFVRVLVRTFFWSFIPGGLMQFTSIALRTASPLLFSQLLQYWSVDSTMARETAMYYALGMILANWLSSFMNHHGALYCQQFGMKIRCAVGSLMFRKIMRMSNGSLGETTAGKVVNLLSNDLQRFDLAMMFLHYVWIIPLQVAAVIYLGYLQVGTAAFIGIAALILIVLPFQGGMGQYLGKLRLRTAEKTDNRIKIMSEVINGIQVIKMYGWEIPFQNVVGQKRADELKEVKRATIVRTVFLGFMMFTERTALFLTVLTYVLLGNVMSANVFYPLQQFMNAAQVNVTLILPLVLSFTAELLVSLGRVEKFLALQDRPDLTGQSEEVSSNLFRNMSAKDNLDNLEMNGSVRPLSYHRKSDGAPIGPTLGAELKKSPNPKFARSVSYQDDTALVVHDVSASWTGDPNALALKNISMRLRKGKLCGIIGAVGSGKSSILQLLLKELPSATGSVSIYGKISYACQEAWLFPSTVRENILFGLPYEPEKYKKVCRVCALEKDFKQFPYSDQTLVGERGVSLSGGQRARINLARAVYREADIYLLDDPLSAVDANVGRQLFEGCINGYLRGRTRILVTHQIHFLKAADYIVVLNEGRIENMGTFEELVNSGKEFSMMLSQLQEGKEKDSDSLGSRSIEEKDRPALKTMASVTEEDDGEEFEAQKMEEEERQSGNLRWEVIAAYFKAGGNACFILFALSMIVLSTTSAASVDYWVSYWTNQMAVYEESLGGADIDPGLDVQVGIFTIAQYLIIHGALVAMCIAIINLRVFPFAYLCVNASSNLHNTMFSTMLKGIMRFFDTSSSGRILNRFTKDMGALDEILPRTLLDVLQIYGTLTAILVLNAIALYWTLLPSAVLLILFIFMVRIYLKAAQGIKRLEGTAKSPMFGTVTSSLSGISTIRSANAQKWLIEQFDTNQDLHTTSWNSYLNGGTTFGFYLDTMCLIYMTTVIGVFLFVDFGDTIPVGSVGLAVTQSNMLTIMLQHGARMLVEFLAQLTSVERILQYTRIDTEPNLFQGKIEMPSSWPSQGKIVFQNVYLRYAPNEQPVLKNLNLVIESGHKVGIVGRTGAGKSSLISALFRFAYIDGLISIDGLDTSLVSRQGLRSKISIIPQEPILFSATIRYNLDPFDMYSDDDLWRALEQVDLKSAIPSLDFNVTEGGSNFSVGQRQLMCLARAVLRSNQILIMDEATANVDPQTDSFIQETIRRQFVSCTVLTIAHRLNTIMDSDKVLVVSSGEIAEYDHPYVLLSDPDSHFSAMVRETGEKNSANLFRIAKDCYFQSNLKENAR

What is claimed is:

1. A recombinant DNA molecule encoding a polypeptide derived from *Spodoptera frugiperda* having an amino acid sequence selected from the group consisting of:
   a) an amino acid sequence as set forth in SEQ ID NO: 181;
   b) an amino acid sequence having at least 90% sequence identity to the full length of the amino acid sequence set forth in SEQ ID NO: 181; and
   c) an amino acid sequence having at least 95% sequence identity to the full length of the amino acid sequence set forth in SEQ ID NO: 181;
   wherein said recombinant DNA molecule is operably linked to a heterologous promoter capable of initiating the transcription of the DNA sequence, and wherein said polypeptide has Bt toxin binding activity.

2. The recombinant DNA of claim 1, wherein said recombinant DNA molecule has a nucleotide sequence of SEQ ID NO: 162.

3. A recombinant DNA vector comprising the recombinant DNA molecule according to claim 1.

4. A non-human transgenic cell transformed with the recombinant DNA molecule according to claim 1.

5. The transgenic cell of claim 4, wherein said transgenic cell is an insect cell.

6. A non-human transgenic organism transformed with the recombinant DNA molecule according to claim 1.

7. The transgenic organism according to claim 6, wherein said transgenic organism is a prokaryotic or a eukaryotic organism.

8. The transgenic organism of claim 6, wherein said transgenic organism is a whole insect.

9. A method to assess the toxicity of a candidate ligand, wherein said method comprises the steps of:
   a) contacting said candidate ligand with cells comprising the recombinant DNA molecule of claim 1 and expressing said polypeptide with Bt toxin binding activity; and,
   b) measuring the toxicity effect of said candidate ligand on said cells in terms of cell death indices.

* * * * *